United States Patent 10,036,017 (METHODS AND COMPOSITIONS FOR THE SPECIFIC INHIBITION OF COMPLEMENT COMPONENT 5(C5) BY DOUBLE-STRANDED RNA) - sequence listing, part 2

SEQ ID NO: 4132 - DNA, 25 bp, Artificial Sequence
  Synthetic oligonucleotide
guugaugauggaguagcuuccuutg

SEQ ID NO: 4133 - DNA, 25 bp, Artificial Sequence
  Synthetic oligonucleotide
uugaugauggaguagcuuccuuugt

SEQ ID NO: 4134 - DNA, 25 bp, Artificial Sequence
  Synthetic oligonucleotide
uuaaucucccaucuggagugacggt

SEQ ID NO: 4135 - DNA, 25 bp, Artificial Sequence
  Synthetic oligonucleotide
uaaucucccaucuggagugacggtg

SEQ ID NO: 4136 - DNA, 25 bp, Artificial Sequence
  Synthetic oligonucleotide
aaucucccaucuggagugacggugc

SEQ ID NO: 4137 - DNA, 25 bp, Artificial Sequence
  Synthetic oligonucleotide
aucucccaucuggagugacggugct

SEQ ID NO: 4138 - DNA, 25 bp, Artificial Sequence
  Synthetic oligonucleotide
ucucccaucuggagugacggugctg

SEQ ID NO: 4139 - DNA, 25 bp, Artificial Sequence
  Synthetic oligonucleotide
ucccaucuggagugacggugcugga

SEQ ID NO: 4140 - DNA, 25 bp, Artificial Sequence
  Synthetic oligonucleotide
ccaucuggagugacggugcuggagt

SEQ ID NO: 4141 - DNA, 25 bp, Artificial Sequence
  Synthetic oligonucleotide
caucuggagugacggugcuggagtt

SEQ ID NO: 4142 - DNA, 25 bp, Artificial Sequence
  Synthetic oligonucleotide
aucuggagugacggugcuggagutt

SEQ ID NO: 4143 - DNA, 25 bp, Artificial Sequence
  Synthetic oligonucleotide
ucuggagugacggugcuggaguuta

SEQ ID NO: 4144 - DNA, 25 bp, Artificial Sequence
  Synthetic oligonucleotide
cuggagugacggugcuggaguuuaa

SEQ ID NO: 4145 - DNA, 25 bp, Artificial Sequence
  Synthetic oligonucleotide
uggagugacggugcuggaguuuaat

SEQ ID NO: 4146 - DNA, 25 bp, Artificial Sequence
  Synthetic oligonucleotide
ggagugacggugcuggaguuuaatg

SEQ ID NO: 4147 - DNA, 25 bp, Artificial Sequence
  Synthetic oligonucleotide
gagugacggugcuggaguuuaaugt

SEQ ID NO: 4148 - DNA, 25 bp, Artificial Sequence
  Synthetic oligonucleotide
agugacggugcuggaguuuaaugtc

SEQ ID NO: 4149 - DNA, 25 bp, Artificial Sequence
  Synthetic oligonucleotide
gugacggugcuggaguuuaauguca

SEQ ID NO: 4150 - DNA, 25 bp, Artificial Sequence
  Synthetic oligonucleotide
ugacggugcuggaguuuaaugucaa

SEQ ID NO: 4151 - DNA, 25 bp, Artificial Sequence
  Synthetic oligonucleotide
gacggugcuggaguuuaaugucaaa

SEQ ID NO: 4152 - DNA, 25 bp, Artificial Sequence
  Synthetic oligonucleotide
acggugcuggaguuuaaugucaaaa

SEQ ID NO: 4153 - DNA, 25 bp, Artificial Sequence
  Synthetic oligonucleotide
cggugcuggaguuuaaugucaaaac

SEQ ID NO: 4154 - DNA, 25 bp, Artificial Sequence
  Synthetic oligonucleotide
ggugcuggaguuuaaugucaaaact

SEQ ID NO: 4155 - DNA, 25 bp, Artificial Sequence
  Synthetic oligonucleotide
gugcuggaguuuaaugucaaaactg

SEQ ID NO: 4156 - DNA, 25 bp, Artificial Sequence
  Synthetic oligonucleotide
ugcuggaguuuaaugucaaaacuga

SEQ ID NO: 4157 - DNA, 25 bp, Artificial Sequence
  Synthetic oligonucleotide
gcuggaguuuaaugucaaaacugat

SEQ ID NO: 4158 - DNA, 25 bp, Artificial Sequence
  Synthetic oligonucleotide
cuggaguuuaaugucaaaacugatg

SEQ ID NO: 4159 - DNA, 25 bp, Artificial Sequence
  Synthetic oligonucleotide
uggaguuuaaugucaaaacugaugc

SEQ ID NO: 4160 - DNA, 25 bp, Artificial Sequence
  Synthetic oligonucleotide
ggaguuuaaugucaaaacugaugct

SEQ ID NO: 4161 - DNA, 25 bp, Artificial Sequence
  Synthetic oligonucleotide
gaguuuaaugucaaaacugaugctc

SEQ ID NO: 4162 - DNA, 25 bp, Artificial Sequence
  Synthetic oligonucleotide
aguuuaaugucaaaacugaugcucc

SEQ ID NO: 4163 - DNA, 25 bp, Artificial Sequence
  Synthetic oligonucleotide
guuuaaugucaaaacugaugcucca

SEQ ID NO: 4164 - DNA, 25 bp, Artificial Sequence
  Synthetic oligonucleotide
uuuaaugucaaaacugaugcuccag

SEQ ID NO: 4165 - DNA, 25 bp, Artificial Sequence
  Synthetic oligonucleotide
uuaaugucaaaacugaugcuccaga

SEQ ID NO: 4166 - DNA, 25 bp, Artificial Sequence
  Synthetic oligonucleotide
uaaugucaaaacugaugcuccagat

SEQ ID NO: 4167 - DNA, 25 bp, Artificial Sequence
  Synthetic oligonucleotide
aaugucaaaacugaugcuccagatc

SEQ ID NO: 4168 - DNA, 25 bp, Artificial Sequence
  Synthetic oligonucleotide
augucaaaacugaugcuccagauct

SEQ ID NO: 4169 - DNA, 25 bp, Artificial Sequence
  Synthetic oligonucleotide
ugucaaaacugaugcuccagauctt

SEQ ID NO: 4170 - DNA, 25 bp, Artificial Sequence
  Synthetic oligonucleotide
gucaaaacugaugcuccagaucutc

SEQ ID NO: 4171 - DNA, 25 bp, Artificial Sequence
  Synthetic oligonucleotide
ucaaaacugaugcuccagaucuucc

SEQ ID NO: 4172 - DNA, 25 bp, Artificial Sequence
  Synthetic oligonucleotide
caaaacugaugcuccagaucuucca

SEQ ID NO: 4173 - DNA, 25 bp, Artificial Sequence
  Synthetic oligonucleotide
aaaacugaugcuccagaucuuccag

SEQ ID NO: 4174 - DNA, 25 bp, Artificial Sequence
  Synthetic oligonucleotide
aaacugaugcuccagaucuuccaga

SEQ ID NO: 4175 - DNA, 25 bp, Artificial Sequence
  Synthetic oligonucleotide
aacugaugcuccagaucuuccagaa

SEQ ID NO: 4176 - DNA, 25 bp, Artificial Sequence
  Synthetic oligonucleotide
acugaugcuccagaucuuccagaag

SEQ ID NO: 4177 - DNA, 25 bp, Artificial Sequence
  Synthetic oligonucleotide
cugaugcuccagaucuuccagaaga

SEQ ID NO: 4178 - DNA, 25 bp, Artificial Sequence
  Synthetic oligonucleotide
ugaugcuccagaucuuccagaagaa

SEQ ID NO: 4179 - DNA, 25 bp, Artificial Sequence
  Synthetic oligonucleotide
gaugcuccagaucuuccagaagaaa

SEQ ID NO: 4180 - DNA, 25 bp, Artificial Sequence
  Synthetic oligonucleotide
augcuccagaucuuccagaagaaaa

SEQ ID NO: 4181 - DNA, 25 bp, Artificial Sequence
  Synthetic oligonucleotide
gaaaaucaggccagggaagguuacc

SEQ ID NO: 4182 - DNA, 25 bp, Artificial Sequence
  Synthetic oligonucleotide
aaaaucaggccagggaagguuaccg

SEQ ID NO: 4183 - DNA, 25 bp, Artificial Sequence
  Synthetic oligonucleotide
aaaucaggccagggaagguuaccga

SEQ ID NO: 4184 - DNA, 25 bp, Artificial Sequence
  Synthetic oligonucleotide
aaucaggccagggaagguuaccgag

SEQ ID NO: 4185 - DNA, 25 bp, Artificial Sequence
  Synthetic oligonucleotide
aucaggccagggaagguuaccgagc

SEQ ID NO: 4186 - DNA, 25 bp, Artificial Sequence
  Synthetic oligonucleotide
ucaggccagggaagguuaccgagca

SEQ ID NO: 4187 - DNA, 25 bp, Artificial Sequence
  Synthetic oligonucleotide
caggccagggaagguuaccgagcaa

SEQ ID NO: 4188 - DNA, 25 bp, Artificial Sequence
  Synthetic oligonucleotide
aggccagggaagguuaccgagcaat

SEQ ID NO: 4189 - DNA, 25 bp, Artificial Sequence
  Synthetic oligonucleotide
ggccagggaagguuaccgagcaata

SEQ ID NO: 4190 - DNA, 25 bp, Artificial Sequence
  Synthetic oligonucleotide
gccagggaagguuaccgagcaauag

SEQ ID NO: 4191 - DNA, 25 bp, Artificial Sequence
  Synthetic oligonucleotide
ccagggaagguuaccgagcaauagc

SEQ ID NO: 4192 - DNA, 25 bp, Artificial Sequence
  Synthetic oligonucleotide
cagggaagguuaccgagcaauagca

SEQ ID NO: 4193 - DNA, 25 bp, Artificial Sequence
  Synthetic oligonucleotide
agggaagguuaccgagcaauagcat

SEQ ID NO: 4194 - DNA, 25 bp, Artificial Sequence
  Synthetic oligonucleotide
gggaagguuaccgagcaauagcata

SEQ ID NO: 4195 - DNA, 25 bp, Artificial Sequence
  Synthetic oligonucleotide
ggaagguuaccgagcaauagcauac

SEQ ID NO: 4196 - DNA, 25 bp, Artificial Sequence
  Synthetic oligonucleotide
gaagguuaccgagcaauagcauact

SEQ ID NO: 4197 - DNA, 25 bp, Artificial Sequence
  Synthetic oligonucleotide
aagguuaccgagcaauagcauactc

SEQ ID NO: 4198 - DNA, 25 bp, Artificial Sequence
  Synthetic oligonucleotide
agguuaccgagcaauagcauacuca

SEQ ID NO: 4199 - DNA, 25 bp, Artificial Sequence
  Synthetic oligonucleotide
guuaccgagcaauagcauacucatc

SEQ ID NO: 4200 - DNA, 25 bp, Artificial Sequence
  Synthetic oligonucleotide
uuaccgagcaauagcauacucauct

SEQ ID NO: 4201 - DNA, 25 bp, Artificial Sequence
  Synthetic oligonucleotide
uaccgagcaauagcauacucauctc

SEQ ID NO: 4202 - DNA, 25 bp, Artificial Sequence
  Synthetic oligonucleotide
accgagcaauagcauacucaucuct

SEQ ID NO: 4203 - DNA, 25 bp, Artificial Sequence
  Synthetic oligonucleotide
ccgagcaauagcauacucaucuctc

SEQ ID NO: 4204 - DNA, 25 bp, Artificial Sequence
  Synthetic oligonucleotide
cgagcaauagcauacucaucucuca

SEQ ID NO: 4205 - DNA, 25 bp, Artificial Sequence
  Synthetic oligonucleotide
gagcaauagcauacucaucucucag

SEQ ID NO: 4206 - DNA, 25 bp, Artificial Sequence
  Synthetic oligonucleotide
agcaauagcauacucaucucucagc

SEQ ID NO: 4207 - DNA, 25 bp, Artificial Sequence
  Synthetic oligonucleotide
gcaauagcauacucaucucucagcc

SEQ ID NO: 4208 - DNA, 25 bp, Artificial Sequence
  Synthetic oligonucleotide
caauagcauacucaucucucagcca

SEQ ID NO: 4209 - DNA, 25 bp, Artificial Sequence
  Synthetic oligonucleotide
aauagcauacucaucucucagccaa

SEQ ID NO: 4210 - DNA, 25 bp, Artificial Sequence
  Synthetic oligonucleotide
auagcauacucaucucucagccaaa

SEQ ID NO: 4211 - DNA, 25 bp, Artificial Sequence
  Synthetic oligonucleotide
uagcauacucaucucucagccaaag

SEQ ID NO: 4212 - DNA, 25 bp, Artificial Sequence
  Synthetic oligonucleotide
agcauacucaucucucagccaaagt

SEQ ID NO: 4213 - DNA, 25 bp, Artificial Sequence
  Synthetic oligonucleotide
gcauacucaucucucagccaaagtt

SEQ ID NO: 4214 - DNA, 25 bp, Artificial Sequence
  Synthetic oligonucleotide
cauacucaucucucagccaaaguta

SEQ ID NO: 4215 - DNA, 25 bp, Artificial Sequence
  Synthetic oligonucleotide
auacucaucucucagccaaaguuac

SEQ ID NO: 4216 - DNA, 25 bp, Artificial Sequence
  Synthetic oligonucleotide
uacucaucucucagccaaaguuacc

SEQ ID NO: 4217 - DNA, 25 bp, Artificial Sequence
  Synthetic oligonucleotide
acucaucucucagccaaaguuacct

SEQ ID NO: 4218 - DNA, 25 bp, Artificial Sequence
  Synthetic oligonucleotide
cucaucucucagccaaaguuacctt

SEQ ID NO: 4219 - DNA, 25 bp, Artificial Sequence
  Synthetic oligonucleotide
ucaucucucagccaaaguuaccutt

SEQ ID NO: 4220 - DNA, 25 bp, Artificial Sequence
  Synthetic oligonucleotide
caucucucagccaaaguuaccuuta

SEQ ID NO: 4221 - DNA, 25 bp, Artificial Sequence
  Synthetic oligonucleotide
aucucucagccaaaguuaccuuuat

SEQ ID NO: 4222 - DNA, 25 bp, Artificial Sequence
  Synthetic oligonucleotide
ucucucagccaaaguuaccuuuata

SEQ ID NO: 4223 - DNA, 25 bp, Artificial Sequence
  Synthetic oligonucleotide
cucucagccaaaguuaccuuuauat

SEQ ID NO: 4224 - DNA, 25 bp, Artificial Sequence
  Synthetic oligonucleotide
ucucagccaaaguuaccuuuauatt

SEQ ID NO: 4225 - DNA, 25 bp, Artificial Sequence
  Synthetic oligonucleotide
cucagccaaaguuaccuuuauautg

SEQ ID NO: 4226 - DNA, 25 bp, Artificial Sequence
  Synthetic oligonucleotide
aaggcuuugcuagugggagaacatc

SEQ ID NO: 4227 - DNA, 25 bp, Artificial Sequence
  Synthetic oligonucleotide
aggcuuugcuagugggagaacauct

SEQ ID NO: 4228 - DNA, 25 bp, Artificial Sequence
  Synthetic oligonucleotide
ggcuuugcuagugggagaacauctg

SEQ ID NO: 4229 - DNA, 25 bp, Artificial Sequence
  Synthetic oligonucleotide
ccaaaagcccauauauugacaaaat

SEQ ID NO: 4230 - DNA, 25 bp, Artificial Sequence
  Synthetic oligonucleotide
caaaagcccauauauugacaaaata

SEQ ID NO: 4231 - DNA, 25 bp, Artificial Sequence
  Synthetic oligonucleotide
aaagcccauauauugacaaaauaac

SEQ ID NO: 4232 - DNA, 25 bp, Artificial Sequence
  Synthetic oligonucleotide
aagcccauauauugacaaaauaact

SEQ ID NO: 4233 - DNA, 25 bp, Artificial Sequence
  Synthetic oligonucleotide
agcccauauauugacaaaauaactc

SEQ ID NO: 4234 - DNA, 25 bp, Artificial Sequence
  Synthetic oligonucleotide
ccauauauugacaaaauaacucact

SEQ ID NO: 4235 - DNA, 25 bp, Artificial Sequence
  Synthetic oligonucleotide
auauugacaaaauaacucacuauaa

SEQ ID NO: 4236 - DNA, 25 bp, Artificial Sequence
  Synthetic oligonucleotide
uauugacaaaauaacucacuauaat

SEQ ID NO: 4237 - DNA, 25 bp, Artificial Sequence
  Synthetic oligonucleotide
uugacaaaauaacucacuauaauta

SEQ ID NO: 4238 - DNA, 25 bp, Artificial Sequence
  Synthetic oligonucleotide
uacuugauuuuauccaagggcaaaa

SEQ ID NO: 4239 - DNA, 25 bp, Artificial Sequence
  Synthetic oligonucleotide
acuugauuuuauccaagggcaaaat

SEQ ID NO: 4240 - DNA, 25 bp, Artificial Sequence
  Synthetic oligonucleotide
cuugauuuuauccaagggcaaaatt

SEQ ID NO: 4241 - DNA, 25 bp, Artificial Sequence
  Synthetic oligonucleotide
uugauuuuauccaagggcaaaauta

SEQ ID NO: 4242 - DNA, 25 bp, Artificial Sequence
  Synthetic oligonucleotide
ugauuuuauccaagggcaaaauuat

SEQ ID NO: 4243 - DNA, 25 bp, Artificial Sequence
  Synthetic oligonucleotide
gauuuuauccaagggcaaaauuatc

SEQ ID NO: 4244 - DNA, 25 bp, Artificial Sequence
  Synthetic oligonucleotide
auuuuauccaagggcaaaauuaucc

SEQ ID NO: 4245 - DNA, 25 bp, Artificial Sequence
  Synthetic oligonucleotide
uuuuauccaagggcaaaauuaucca

SEQ ID NO: 4246 - DNA, 25 bp, Artificial Sequence
  Synthetic oligonucleotide
uuuauccaagggcaaaauuauccac

SEQ ID NO: 4247 - DNA, 25 bp, Artificial Sequence
  Synthetic oligonucleotide
uuauccaagggcaaaauuauccact

SEQ ID NO: 4248 - DNA, 25 bp, Artificial Sequence
  Synthetic oligonucleotide
uauccaagggcaaaauuauccactt

SEQ ID NO: 4249 - DNA, 25 bp, Artificial Sequence
  Synthetic oligonucleotide
auccaagggcaaaauuauccacutt

SEQ ID NO: 4250 - DNA, 25 bp, Artificial Sequence
  Synthetic oligonucleotide
uccaagggcaaaauuauccacuutg

SEQ ID NO: 4251 - DNA, 25 bp, Artificial Sequence
  Synthetic oligonucleotide
ccaagggcaaaauuauccacuuugg

SEQ ID NO: 4252 - DNA, 25 bp, Artificial Sequence
  Synthetic oligonucleotide
caagggcaaaauuauccacuuuggc

SEQ ID NO: 4253 - DNA, 25 bp, Artificial Sequence
  Synthetic oligonucleotide
aagggcaaaauuauccacuuuggca

SEQ ID NO: 4254 - DNA, 25 bp, Artificial Sequence
  Synthetic oligonucleotide
agggcaaaauuauccacuuuggcac

SEQ ID NO: 4255 - DNA, 25 bp, Artificial Sequence
  Synthetic oligonucleotide
gggcaaaauuauccacuuuggcacg

SEQ ID NO: 4256 - DNA, 25 bp, Artificial Sequence
  Synthetic oligonucleotide
ggcaaaauuauccacuuuggcacga

SEQ ID NO: 4257 - DNA, 25 bp, Artificial Sequence
  Synthetic oligonucleotide
gcaaaauuauccacuuuggcacgag

SEQ ID NO: 4258 - DNA, 25 bp, Artificial Sequence
  Synthetic oligonucleotide
caaaauuauccacuuuggcacgagg

SEQ ID NO: 4259 - DNA, 25 bp, Artificial Sequence
  Synthetic oligonucleotide
aaaauuauccacuuuggcacgaggg

SEQ ID NO: 4260 - DNA, 25 bp, Artificial Sequence
  Synthetic oligonucleotide
aaauuauccacuuuggcacgaggga

SEQ ID NO: 4261 - DNA, 25 bp, Artificial Sequence
  Synthetic oligonucleotide
uuucagaugcaucuuaucaaaguat

SEQ ID NO: 4262 - DNA, 25 bp, Artificial Sequence
  Synthetic oligonucleotide
uucagaugcaucuuaucaaaguata

SEQ ID NO: 4263 - DNA, 25 bp, Artificial Sequence
  Synthetic oligonucleotide
ucagaugcaucuuaucaaaguauaa

SEQ ID NO: 4264 - DNA, 25 bp, Artificial Sequence
  Synthetic oligonucleotide
cagaugcaucuuaucaaaguauaaa

SEQ ID NO: 4265 - DNA, 25 bp, Artificial Sequence
  Synthetic oligonucleotide
agaugcaucuuaucaaaguauaaac

SEQ ID NO: 4266 - DNA, 25 bp, Artificial Sequence
  Synthetic oligonucleotide
gaugcaucuuaucaaaguauaaaca

SEQ ID NO: 4267 - DNA, 25 bp, Artificial Sequence
  Synthetic oligonucleotide
augcaucuuaucaaaguauaaacat

SEQ ID NO: 4268 - DNA, 25 bp, Artificial Sequence
  Synthetic oligonucleotide
ugcaucuuaucaaaguauaaacatt

SEQ ID NO: 4269 - DNA, 25 bp, Artificial Sequence
  Synthetic oligonucleotide
gcaucuuaucaaaguauaaacautc

SEQ ID NO: 4270 - DNA, 25 bp, Artificial Sequence
  Synthetic oligonucleotide
caucuuaucaaaguauaaacauucc

SEQ ID NO: 4271 - DNA, 25 bp, Artificial Sequence
  Synthetic oligonucleotide
aucuuaucaaaguauaaacauucca

SEQ ID NO: 4272 - DNA, 25 bp, Artificial Sequence
  Synthetic oligonucleotide
ucuuaucaaaguauaaacauuccag

SEQ ID NO: 4273 - DNA, 25 bp, Artificial Sequence
  Synthetic oligonucleotide
cuuaucaaaguauaaacauuccagt

SEQ ID NO: 4274 - DNA, 25 bp, Artificial Sequence
  Synthetic oligonucleotide
uuaucaaaguauaaacauuccagta

SEQ ID NO: 4275 - DNA, 25 bp, Artificial Sequence
  Synthetic oligonucleotide
uaucaaaguauaaacauuccaguaa

SEQ ID NO: 4276 - DNA, 25 bp, Artificial Sequence
  Synthetic oligonucleotide
aucaaaguauaaacauuccaguaac

SEQ ID NO: 4277 - DNA, 25 bp, Artificial Sequence
  Synthetic oligonucleotide
ucaaaguauaaacauuccaguaaca

SEQ ID NO: 4278 - DNA, 25 bp, Artificial Sequence
  Synthetic oligonucleotide
caaaguauaaacauuccaguaacac

SEQ ID NO: 4279 - DNA, 25 bp, Artificial Sequence
  Synthetic oligonucleotide
cagaacaugguuccuucaucccgac

SEQ ID NO: 4280 - DNA, 25 bp, Artificial Sequence
  Synthetic oligonucleotide
agaacaugguuccuucaucccgact

SEQ ID NO: 4281 - DNA, 25 bp, Artificial Sequence
  Synthetic oligonucleotide
gaacaugguuccuucaucccgactt

SEQ ID NO: 4282 - DNA, 25 bp, Artificial Sequence
  Synthetic oligonucleotide
aacaugguuccuucaucccgacutc

SEQ ID NO: 4283 - DNA, 25 bp, Artificial Sequence
  Synthetic oligonucleotide
acaugguuccuucaucccgacuuct

SEQ ID NO: 4284 - DNA, 25 bp, Artificial Sequence
  Synthetic oligonucleotide
caugguuccuucaucccgacuuctg

SEQ ID NO: 4285 - DNA, 25 bp, Artificial Sequence
  Synthetic oligonucleotide
augguuccuucaucccgacuucugg

SEQ ID NO: 4286 - DNA, 25 bp, Artificial Sequence
  Synthetic oligonucleotide
ugguuccuucaucccgacuucuggt

SEQ ID NO: 4287 - DNA, 25 bp, Artificial Sequence
  Synthetic oligonucleotide
cuggucuauuacaucgucacaggag

SEQ ID NO: 4288 - DNA, 25 bp, Artificial Sequence
  Synthetic oligonucleotide
uggucuauuacaucgucacaggaga

SEQ ID NO: 4289 - DNA, 25 bp, Artificial Sequence
  Synthetic oligonucleotide
ggucuauuacaucgucacaggagaa

SEQ ID NO: 4290 - DNA, 25 bp, Artificial Sequence
  Synthetic oligonucleotide
gucuauuacaucgucacaggagaac

SEQ ID NO: 4291 - DNA, 25 bp, Artificial Sequence
  Synthetic oligonucleotide
ucuauuacaucgucacaggagaaca

SEQ ID NO: 4292 - DNA, 25 bp, Artificial Sequence
  Synthetic oligonucleotide
cuauuacaucgucacaggagaacag

SEQ ID NO: 4293 - DNA, 25 bp, Artificial Sequence
  Synthetic oligonucleotide
uauuacaucgucacaggagaacaga

SEQ ID NO: 4294 - DNA, 25 bp, Artificial Sequence
  Synthetic oligonucleotide
auuacaucgucacaggagaacagac

SEQ ID NO: 4295 - DNA, 25 bp, Artificial Sequence
  Synthetic oligonucleotide
cagacagcagaauuagugucugatt

SEQ ID NO: 4296 - DNA, 25 bp, Artificial Sequence
  Synthetic oligonucleotide
agacagcagaauuagugucugautc

SEQ ID NO: 4297 - DNA, 25 bp, Artificial Sequence
  Synthetic oligonucleotide
gacagcagaauuagugucugauuca

SEQ ID NO: 4298 - DNA, 25 bp, Artificial Sequence
  Synthetic oligonucleotide
acagcagaauuagugucugauucag

SEQ ID NO: 4299 - DNA, 25 bp, Artificial Sequence
  Synthetic oligonucleotide
cagcagaauuagugucugauucagt

SEQ ID NO: 4300 - DNA, 25 bp, Artificial Sequence
  Synthetic oligonucleotide
agcagaauuagugucugauucagtc

SEQ ID NO: 4301 - DNA, 25 bp, Artificial Sequence
  Synthetic oligonucleotide
gcagaauuagugucugauucaguct

SEQ ID NO: 4302 - DNA, 25 bp, Artificial Sequence
  Synthetic oligonucleotide
cagaauuagugucugauucaguctg

SEQ ID NO: 4303 - DNA, 25 bp, Artificial Sequence
  Synthetic oligonucleotide
agaauuagugucugauucagucugg

SEQ ID NO: 4304 - DNA, 25 bp, Artificial Sequence
  Synthetic oligonucleotide
gaauuagugucugauucagucuggt

SEQ ID NO: 4305 - DNA, 25 bp, Artificial Sequence
  Synthetic oligonucleotide
aauuagugucugauucagucuggtt

SEQ ID NO: 4306 - DNA, 25 bp, Artificial Sequence
  Synthetic oligonucleotide
auuagugucugauucagucugguta

SEQ ID NO: 4307 - DNA, 25 bp, Artificial Sequence
  Synthetic oligonucleotide
uuagugucugauucagucugguuaa

SEQ ID NO: 4308 - DNA, 25 bp, Artificial Sequence
  Synthetic oligonucleotide
uagugucugauucagucugguuaaa

SEQ ID NO: 4309 - DNA, 25 bp, Artificial Sequence
  Synthetic oligonucleotide
agugucugauucagucugguuaaat

SEQ ID NO: 4310 - DNA, 25 bp, Artificial Sequence
  Synthetic oligonucleotide
gugucugauucagucugguuaaata

SEQ ID NO: 4311 - DNA, 25 bp, Artificial Sequence
  Synthetic oligonucleotide
ugucugauucagucugguuaaauat

SEQ ID NO: 4312 - DNA, 25 bp, Artificial Sequence
  Synthetic oligonucleotide
ucugauucagucugguuaaauautg

SEQ ID NO: 4313 - DNA, 25 bp, Artificial Sequence
  Synthetic oligonucleotide
uucagucugguuaaauauugaagaa

SEQ ID NO: 4314 - DNA, 25 bp, Artificial Sequence
  Synthetic oligonucleotide
guuaaauauugaagaaaaauguggc

SEQ ID NO: 4315 - DNA, 25 bp, Artificial Sequence
  Synthetic oligonucleotide
uuaaauauugaagaaaaauguggca

SEQ ID NO: 4316 - DNA, 25 bp, Artificial Sequence
  Synthetic oligonucleotide
uaaauauugaagaaaaauguggcaa

SEQ ID NO: 4317 - DNA, 25 bp, Artificial Sequence
  Synthetic oligonucleotide
aaauauugaagaaaaauguggcaac

SEQ ID NO: 4318 - DNA, 25 bp, Artificial Sequence
  Synthetic oligonucleotide
aauauugaagaaaaauguggcaacc

SEQ ID NO: 4319 - DNA, 25 bp, Artificial Sequence
  Synthetic oligonucleotide
auauugaagaaaaauguggcaacca

SEQ ID NO: 4320 - DNA, 25 bp, Artificial Sequence
  Synthetic oligonucleotide
uauugaagaaaaauguggcaaccag

SEQ ID NO: 4321 - DNA, 25 bp, Artificial Sequence
  Synthetic oligonucleotide
auugaagaaaaauguggcaaccagc

SEQ ID NO: 4322 - DNA, 25 bp, Artificial Sequence
  Synthetic oligonucleotide
uugaagaaaaauguggcaaccagct

SEQ ID NO: 4323 - DNA, 25 bp, Artificial Sequence
  Synthetic oligonucleotide
ugaagaaaaauguggcaaccagctc

SEQ ID NO: 4324 - DNA, 25 bp, Artificial Sequence
  Synthetic oligonucleotide
gaagaaaaauguggcaaccagcucc

SEQ ID NO: 4325 - DNA, 25 bp, Artificial Sequence
  Synthetic oligonucleotide
aagaaaaauguggcaaccagcucca

SEQ ID NO: 4326 - DNA, 25 bp, Artificial Sequence
  Synthetic oligonucleotide
agaaaaauguggcaaccagcuccag

SEQ ID NO: 4327 - DNA, 25 bp, Artificial Sequence
  Synthetic oligonucleotide
gaaaaauguggcaaccagcuccagg

SEQ ID NO: 4328 - DNA, 25 bp, Artificial Sequence
  Synthetic oligonucleotide
aaaaauguggcaaccagcuccaggt

SEQ ID NO: 4329 - DNA, 25 bp, Artificial Sequence
  Synthetic oligonucleotide
aaaauguggcaaccagcuccaggtt

SEQ ID NO: 4330 - DNA, 25 bp, Artificial Sequence
  Synthetic oligonucleotide
aaauguggcaaccagcuccaggutc

SEQ ID NO: 4331 - DNA, 25 bp, Artificial Sequence
  Synthetic oligonucleotide
aauguggcaaccagcuccagguuca

SEQ ID NO: 4332 - DNA, 25 bp, Artificial Sequence
  Synthetic oligonucleotide
auguggcaaccagcuccagguucat

SEQ ID NO: 4333 - DNA, 25 bp, Artificial Sequence
  Synthetic oligonucleotide
uggcaaccagcuccagguucauctg

SEQ ID NO: 4334 - DNA, 25 bp, Artificial Sequence
  Synthetic oligonucleotide
ggcaaccagcuccagguucaucugt

SEQ ID NO: 4335 - DNA, 25 bp, Artificial Sequence
  Synthetic oligonucleotide
gcaaccagcuccagguucaucugtc

SEQ ID NO: 4336 - DNA, 25 bp, Artificial Sequence
  Synthetic oligonucleotide
caaccagcuccagguucaucuguct

SEQ ID NO: 4337 - DNA, 25 bp, Artificial Sequence
  Synthetic oligonucleotide
aaccagcuccagguucaucuguctc

SEQ ID NO: 4338 - DNA, 25 bp, Artificial Sequence
  Synthetic oligonucleotide
accagcuccagguucaucugucucc

SEQ ID NO: 4339 - DNA, 25 bp, Artificial Sequence
  Synthetic oligonucleotide
ccagcuccagguucaucugucucct

SEQ ID NO: 4340 - DNA, 25 bp, Artificial Sequence
  Synthetic oligonucleotide
cagcuccagguucaucugucucctg

SEQ ID NO: 4341 - DNA, 25 bp, Artificial Sequence
  Synthetic oligonucleotide
agcuccagguucaucugucuccuga

SEQ ID NO: 4342 - DNA, 25 bp, Artificial Sequence
  Synthetic oligonucleotide
gcuccagguucaucugucuccugat

SEQ ID NO: 4343 - DNA, 25 bp, Artificial Sequence
  Synthetic oligonucleotide
cuccagguucaucugucuccugatg

SEQ ID NO: 4344 - DNA, 25 bp, Artificial Sequence
  Synthetic oligonucleotide
uccagguucaucugucuccugaugc

SEQ ID NO: 4345 - DNA, 25 bp, Artificial Sequence
  Synthetic oligonucleotide
ccagguucaucugucuccugaugca

SEQ ID NO: 4346 - DNA, 25 bp, Artificial Sequence
  Synthetic oligonucleotide
cagguucaucugucuccugaugcag

SEQ ID NO: 4347 - DNA, 25 bp, Artificial Sequence
  Synthetic oligonucleotide
agguucaucugucuccugaugcaga

SEQ ID NO: 4348 - DNA, 25 bp, Artificial Sequence
  Synthetic oligonucleotide
gguucaucugucuccugaugcagat

SEQ ID NO: 4349 - DNA, 25 bp, Artificial Sequence
  Synthetic oligonucleotide
guucaucugucuccugaugcagatg

SEQ ID NO: 4350 - DNA, 25 bp, Artificial Sequence
  Synthetic oligonucleotide
uucaucugucuccugaugcagaugc

SEQ ID NO: 4351 - DNA, 25 bp, Artificial Sequence
  Synthetic oligonucleotide
ucaucugucuccugaugcagaugca

SEQ ID NO: 4352 - DNA, 25 bp, Artificial Sequence
  Synthetic oligonucleotide
caucugucuccugaugcagaugcat

SEQ ID NO: 4353 - DNA, 25 bp, Artificial Sequence
  Synthetic oligonucleotide
aucugucuccugaugcagaugcata

SEQ ID NO: 4354 - DNA, 25 bp, Artificial Sequence
  Synthetic oligonucleotide
ucugucuccugaugcagaugcauat

SEQ ID NO: 4355 - DNA, 25 bp, Artificial Sequence
  Synthetic oligonucleotide
auggauuccuggguggcauuagcag

SEQ ID NO: 4356 - DNA, 25 bp, Artificial Sequence
  Synthetic oligonucleotide
uggauuccuggguggcauuagcagc

SEQ ID NO: 4357 - DNA, 25 bp, Artificial Sequence
  Synthetic oligonucleotide
ggauuccuggguggcauuagcagca

SEQ ID NO: 4358 - DNA, 25 bp, Artificial Sequence
  Synthetic oligonucleotide
gagccaaaaagcccuuggaaagagt

SEQ ID NO: 4359 - DNA, 25 bp, Artificial Sequence
  Synthetic oligonucleotide
agccaaaaagcccuuggaaagagta

SEQ ID NO: 4360 - DNA, 25 bp, Artificial Sequence
  Synthetic oligonucleotide
gccaaaaagcccuuggaaagaguat

SEQ ID NO: 4361 - DNA, 25 bp, Artificial Sequence
  Synthetic oligonucleotide
ccaaaaagcccuuggaaagaguatt

SEQ ID NO: 4362 - DNA, 25 bp, Artificial Sequence
  Synthetic oligonucleotide
caaaaagcccuuggaaagaguautt

SEQ ID NO: 4363 - DNA, 25 bp, Artificial Sequence
  Synthetic oligonucleotide
aaaaagcccuuggaaagaguauutc

SEQ ID NO: 4364 - DNA, 25 bp, Artificial Sequence
  Synthetic oligonucleotide
aaaagcccuuggaaagaguauuuca

SEQ ID NO: 4365 - DNA, 25 bp, Artificial Sequence
  Synthetic oligonucleotide
aaagcccuuggaaagaguauuucaa

SEQ ID NO: 4366 - DNA, 25 bp, Artificial Sequence
  Synthetic oligonucleotide
aagcccuuggaaagaguauuucaat

SEQ ID NO: 4367 - DNA, 25 bp, Artificial Sequence
  Synthetic oligonucleotide
agcccuuggaaagaguauuucaatt

SEQ ID NO: 4368 - DNA, 25 bp, Artificial Sequence
  Synthetic oligonucleotide
gcccuuggaaagaguauuucaautc

SEQ ID NO: 4369 - DNA, 25 bp, Artificial Sequence
  Synthetic oligonucleotide
cccuuggaaagaguauuucaauuct

SEQ ID NO: 4370 - DNA, 25 bp, Artificial Sequence
  Synthetic oligonucleotide
ccuuggaaagaguauuucaauuctt

SEQ ID NO: 4371 - DNA, 25 bp, Artificial Sequence
  Synthetic oligonucleotide
cuuggaaagaguauuucaauucuta

SEQ ID NO: 4372 - DNA, 25 bp, Artificial Sequence
  Synthetic oligonucleotide
uuggaaagaguauuucaauucuuag

SEQ ID NO: 4373 - DNA, 25 bp, Artificial Sequence
  Synthetic oligonucleotide
uggaaagaguauuucaauucuuaga

SEQ ID NO: 4374 - DNA, 25 bp, Artificial Sequence
  Synthetic oligonucleotide
ggaaagaguauuucaauucuuagag

SEQ ID NO: 4375 - DNA, 25 bp, Artificial Sequence
  Synthetic oligonucleotide
gaaagaguauuucaauucuuagaga

SEQ ID NO: 4376 - DNA, 25 bp, Artificial Sequence
  Synthetic oligonucleotide
aaagaguauuucaauucuuagagaa

SEQ ID NO: 4377 - DNA, 25 bp, Artificial Sequence
  Synthetic oligonucleotide
aagaguauuucaauucuuagagaag

SEQ ID NO: 4378 - DNA, 25 bp, Artificial Sequence
  Synthetic oligonucleotide
agaguauuucaauucuuagagaaga

SEQ ID NO: 4379 - DNA, 25 bp, Artificial Sequence
  Synthetic oligonucleotide
gaguauuucaauucuuagagaagag

SEQ ID NO: 4380 - DNA, 25 bp, Artificial Sequence
  Synthetic oligonucleotide
aguauuucaauucuuagagaagagt

SEQ ID NO: 4381 - DNA, 25 bp, Artificial Sequence
  Synthetic oligonucleotide
guauuucaauucuuagagaagagtg

SEQ ID NO: 4382 - DNA, 25 bp, Artificial Sequence
  Synthetic oligonucleotide
uauuucaauucuuagagaagaguga

SEQ ID NO: 4383 - DNA, 25 bp, Artificial Sequence
  Synthetic oligonucleotide
auuucaauucuuagagaagagugat

SEQ ID NO: 4384 - DNA, 25 bp, Artificial Sequence
  Synthetic oligonucleotide
uuucaauucuuagagaagagugatc

SEQ ID NO: 4385 - DNA, 25 bp, Artificial Sequence
  Synthetic oligonucleotide
uucaauucuuagagaagagugauct

SEQ ID NO: 4386 - DNA, 25 bp, Artificial Sequence
  Synthetic oligonucleotide
ucaauucuuagagaagagugauctg

SEQ ID NO: 4387 - DNA, 25 bp, Artificial Sequence
  Synthetic oligonucleotide
caauucuuagagaagagugaucugg

SEQ ID NO: 4388 - DNA, 25 bp, Artificial Sequence
  Synthetic oligonucleotide
aauucuuagagaagagugaucuggg

SEQ ID NO: 4389 - DNA, 25 bp, Artificial Sequence
  Synthetic oligonucleotide
auucuuagagaagagugaucugggc

SEQ ID NO: 4390 - DNA, 25 bp, Artificial Sequence
  Synthetic oligonucleotide
uucuuagagaagagugaucugggct

SEQ ID NO: 4391 - DNA, 25 bp, Artificial Sequence
  Synthetic oligonucleotide
cuuagagaagagugaucugggcugt

SEQ ID NO: 4392 - DNA, 25 bp, Artificial Sequence
  Synthetic oligonucleotide
uuagagaagagugaucugggcugtg

SEQ ID NO: 4393 - DNA, 25 bp, Artificial Sequence
  Synthetic oligonucleotide
agagaagagugaucugggcuguggg

SEQ ID NO: 4394 - DNA, 25 bp, Artificial Sequence
  Synthetic oligonucleotide
uggggcaggugguggccucaacaat

SEQ ID NO: 4395 - DNA, 25 bp, Artificial Sequence
  Synthetic oligonucleotide
gcaggugguggccucaacaaugcca

SEQ ID NO: 4396 - DNA, 25 bp, Artificial Sequence
  Synthetic oligonucleotide
caggugguggccucaacaaugccaa

SEQ ID NO: 4397 - DNA, 25 bp, Artificial Sequence
  Synthetic oligonucleotide
aggugguggccucaacaaugccaat

SEQ ID NO: 4398 - DNA, 25 bp, Artificial Sequence
  Synthetic oligonucleotide
ggugguggccucaacaaugccaatg

SEQ ID NO: 4399 - DNA, 25 bp, Artificial Sequence
  Synthetic oligonucleotide
gugguggccucaacaaugccaaugt

SEQ ID NO: 4400 - DNA, 25 bp, Artificial Sequence
  Synthetic oligonucleotide
ugguggccucaacaaugccaaugtg

SEQ ID NO: 4401 - DNA, 25 bp, Artificial Sequence
  Synthetic oligonucleotide
guuccaccuagcuggacuuaccutc

SEQ ID NO: 4402 - DNA, 25 bp, Artificial Sequence
  Synthetic oligonucleotide
uuccaccuagcuggacuuaccuucc

SEQ ID NO: 4403 - DNA, 25 bp, Artificial Sequence
  Synthetic oligonucleotide
uccaccuagcuggacuuaccuucct

SEQ ID NO: 4404 - DNA, 25 bp, Artificial Sequence
  Synthetic oligonucleotide
ccaccuagcuggacuuaccuucctc

SEQ ID NO: 4405 - DNA, 25 bp, Artificial Sequence
  Synthetic oligonucleotide
caccuagcuggacuuaccuuccuca

SEQ ID NO: 4406 - DNA, 25 bp, Artificial Sequence
  Synthetic oligonucleotide
accuagcuggacuuaccuuccucac

SEQ ID NO: 4407 - DNA, 25 bp, Artificial Sequence
  Synthetic oligonucleotide
ccuagcuggacuuaccuuccucact

SEQ ID NO: 4408 - DNA, 25 bp, Artificial Sequence
  Synthetic oligonucleotide
cuagcuggacuuaccuuccucacta

SEQ ID NO: 4409 - DNA, 25 bp, Artificial Sequence
  Synthetic oligonucleotide
uagcuggacuuaccuuccucacuaa

SEQ ID NO: 4410 - DNA, 25 bp, Artificial Sequence
  Synthetic oligonucleotide
agcuggacuuaccuuccucacuaat

SEQ ID NO: 4411 - DNA, 25 bp, Artificial Sequence
  Synthetic oligonucleotide
gcuggacuuaccuuccucacuaatg

SEQ ID NO: 4412 - DNA, 25 bp, Artificial Sequence
  Synthetic oligonucleotide
cuggacuuaccuuccucacuaaugc

SEQ ID NO: 4413 - DNA, 25 bp, Artificial Sequence
  Synthetic oligonucleotide
uggacuuaccuuccucacuaaugca

SEQ ID NO: 4414 - DNA, 25 bp, Artificial Sequence
  Synthetic oligonucleotide
ggacuuaccuuccucacuaaugcaa

SEQ ID NO: 4415 - DNA, 25 bp, Artificial Sequence
  Synthetic oligonucleotide
gacuuaccuuccucacuaaugcaaa

SEQ ID NO: 4416 - DNA, 25 bp, Artificial Sequence
  Synthetic oligonucleotide
acuuaccuuccucacuaaugcaaat

SEQ ID NO: 4417 - DNA, 25 bp, Artificial Sequence
  Synthetic oligonucleotide
cuuaccuuccucacuaaugcaaatg

SEQ ID NO: 4418 - DNA, 25 bp, Artificial Sequence
  Synthetic oligonucleotide
uuaccuuccucacuaaugcaaaugc

SEQ ID NO: 4419 - DNA, 25 bp, Artificial Sequence
  Synthetic oligonucleotide
uaccuuccucacuaaugcaaaugca

SEQ ID NO: 4420 - DNA, 25 bp, Artificial Sequence
  Synthetic oligonucleotide
accuuccucacuaaugcaaaugcag

SEQ ID NO: 4421 - DNA, 25 bp, Artificial Sequence
  Synthetic oligonucleotide
ccuuccucacuaaugcaaaugcaga

SEQ ID NO: 4422 - DNA, 25 bp, Artificial Sequence
  Synthetic oligonucleotide
cuuccucacuaaugcaaaugcagat

SEQ ID NO: 4423 - DNA, 25 bp, Artificial Sequence
  Synthetic oligonucleotide
uuccucacuaaugcaaaugcagatg

SEQ ID NO: 4424 - DNA, 25 bp, Artificial Sequence
  Synthetic oligonucleotide
uccucacuaaugcaaaugcagauga

SEQ ID NO: 4425 - DNA, 25 bp, Artificial Sequence
  Synthetic oligonucleotide
ccucacuaaugcaaaugcagaugac

SEQ ID NO: 4426 - DNA, 25 bp, Artificial Sequence
  Synthetic oligonucleotide
cucacuaaugcaaaugcagaugact

SEQ ID NO: 4427 - DNA, 25 bp, Artificial Sequence
  Synthetic oligonucleotide
ucacuaaugcaaaugcagaugactc

SEQ ID NO: 4428 - DNA, 25 bp, Artificial Sequence
  Synthetic oligonucleotide
cacuaaugcaaaugcagaugacucc

SEQ ID NO: 4429 - DNA, 25 bp, Artificial Sequence
  Synthetic oligonucleotide
acuaaugcaaaugcagaugacuccc

SEQ ID NO: 4430 - DNA, 25 bp, Artificial Sequence
  Synthetic oligonucleotide
cuaaugcaaaugcagaugacuccca

SEQ ID NO: 4431 - DNA, 25 bp, Artificial Sequence
  Synthetic oligonucleotide
uaaugcaaaugcagaugacucccaa

SEQ ID NO: 4432 - DNA, 25 bp, Artificial Sequence
  Synthetic oligonucleotide
aaugcaaaugcagaugacucccaag

SEQ ID NO: 4433 - DNA, 25 bp, Artificial Sequence
  Synthetic oligonucleotide
augcaaaugcagaugacucccaaga

SEQ ID NO: 4434 - DNA, 25 bp, Artificial Sequence
  Synthetic oligonucleotide
ugcaaaugcagaugacucccaagaa

SEQ ID NO: 4435 - DNA, 25 bp, Artificial Sequence
  Synthetic oligonucleotide
gcaaaugcagaugacucccaagaaa

SEQ ID NO: 4436 - DNA, 25 bp, Artificial Sequence
  Synthetic oligonucleotide
caaaugcagaugacucccaagaaaa

SEQ ID NO: 4437 - DNA, 25 bp, Artificial Sequence
  Synthetic oligonucleotide
aaaugcagaugacucccaagaaaat

SEQ ID NO: 4438 - DNA, 25 bp, Artificial Sequence
  Synthetic oligonucleotide
aaugcagaugacucccaagaaaatg

SEQ ID NO: 4439 - DNA, 25 bp, Artificial Sequence
  Synthetic oligonucleotide
augcagaugacucccaagaaaauga

SEQ ID NO: 4440 - DNA, 25 bp, Artificial Sequence
  Synthetic oligonucleotide
ugcagaugacucccaagaaaaugat

SEQ ID NO: 4441 - DNA, 25 bp, Artificial Sequence
  Synthetic oligonucleotide
gcagaugacucccaagaaaaugatg

SEQ ID NO: 4442 - DNA, 25 bp, Artificial Sequence
  Synthetic oligonucleotide
cagaugacucccaagaaaaugauga

SEQ ID NO: 4443 - DNA, 25 bp, Artificial Sequence
  Synthetic oligonucleotide
agaugacucccaagaaaaugaugaa

SEQ ID NO: 4444 - DNA, 25 bp, Artificial Sequence
  Synthetic oligonucleotide
gaugacucccaagaaaaugaugaac

SEQ ID NO: 4445 - DNA, 25 bp, Artificial Sequence
  Synthetic oligonucleotide
augacucccaagaaaaugaugaacc

SEQ ID NO: 4446 - DNA, 25 bp, Artificial Sequence
  Synthetic oligonucleotide
ugacucccaagaaaaugaugaacct

SEQ ID NO: 4447 - DNA, 25 bp, Artificial Sequence
  Synthetic oligonucleotide
gacucccaagaaaaugaugaacctt

SEQ ID NO: 4448 - DNA, 25 bp, Artificial Sequence
  Synthetic oligonucleotide
acucccaagaaaaugaugaaccutg

SEQ ID NO: 4449 - DNA, 25 bp, Artificial Sequence
  Synthetic oligonucleotide
cucccaagaaaaugaugaaccuugt

SEQ ID NO: 4450 - DNA, 25 bp, Artificial Sequence
  Synthetic oligonucleotide
ucccaagaaaaugaugaaccuugta

SEQ ID NO: 4451 - DNA, 25 bp, Artificial Sequence
  Synthetic oligonucleotide
cccaagaaaaugaugaaccuuguaa

SEQ ID NO: 4452 - DNA, 25 bp, Artificial Sequence
  Synthetic oligonucleotide
ccaagaaaaugaugaaccuuguaaa

SEQ ID NO: 4453 - DNA, 25 bp, Artificial Sequence
  Synthetic oligonucleotide
caagaaaaugaugaaccuuguaaag

SEQ ID NO: 4454 - DNA, 25 bp, Artificial Sequence
  Synthetic oligonucleotide
aagaaaaugaugaaccuuguaaaga

SEQ ID NO: 4455 - DNA, 25 bp, Artificial Sequence
  Synthetic oligonucleotide
gaaaaugaugaaccuuguaaagaaa

SEQ ID NO: 4456 - DNA, 25 bp, Artificial Sequence
  Synthetic oligonucleotide
aaaaugaugaaccuuguaaagaaat

SEQ ID NO: 4457 - DNA, 25 bp, Artificial Sequence
  Synthetic oligonucleotide
aaaugaugaaccuuguaaagaaatt

SEQ ID NO: 4458 - DNA, 25 bp, Artificial Sequence
  Synthetic oligonucleotide
aaugaugaaccuuguaaagaaautc

SEQ ID NO: 4459 - DNA, 25 bp, Artificial Sequence
  Synthetic oligonucleotide
ugaugaaccuuguaaagaaauuctc

SEQ ID NO: 4460 - DNA, 25 bp, Artificial Sequence
  Synthetic oligonucleotide
ugaaccuuguaaagaaauucucagg

SEQ ID NO: 4461 - DNA, 25 bp, Artificial Sequence
  Synthetic oligonucleotide
agaagauagaagaaauagcugcuaa

SEQ ID NO: 4462 - DNA, 25 bp, Artificial Sequence
  Synthetic oligonucleotide
gaagauagaagaaauagcugcuaaa

SEQ ID NO: 4463 - DNA, 25 bp, Artificial Sequence
  Synthetic oligonucleotide
aagauagaagaaauagcugcuaaat

SEQ ID NO: 4464 - DNA, 25 bp, Artificial Sequence
  Synthetic oligonucleotide
agauagaagaaauagcugcuaaata

SEQ ID NO: 4465 - DNA, 25 bp, Artificial Sequence
  Synthetic oligonucleotide
gauagaagaaauagcugcuaaauat

SEQ ID NO: 4466 - DNA, 25 bp, Artificial Sequence
  Synthetic oligonucleotide
auagaagaaauagcugcuaaauata

SEQ ID NO: 4467 - DNA, 25 bp, Artificial Sequence
  Synthetic oligonucleotide
uagaagaaauagcugcuaaauauaa

SEQ ID NO: 4468 - DNA, 25 bp, Artificial Sequence
  Synthetic oligonucleotide
agaagaaauagcugcuaaauauaaa

SEQ ID NO: 4469 - DNA, 25 bp, Artificial Sequence
  Synthetic oligonucleotide
gaagaaauagcugcuaaauauaaac

SEQ ID NO: 4470 - DNA, 25 bp, Artificial Sequence
  Synthetic oligonucleotide
aagaaauagcugcuaaauauaaaca

SEQ ID NO: 4471 - DNA, 25 bp, Artificial Sequence
  Synthetic oligonucleotide
agaaauagcugcuaaauauaaacat

SEQ ID NO: 4472 - DNA, 25 bp, Artificial Sequence
  Synthetic oligonucleotide
gaaauagcugcuaaauauaaacatt

SEQ ID NO: 4473 - DNA, 25 bp, Artificial Sequence
  Synthetic oligonucleotide
aaauagcugcuaaauauaaacautc

SEQ ID NO: 4474 - DNA, 25 bp, Artificial Sequence
  Synthetic oligonucleotide
aauagcugcuaaauauaaacauuca

SEQ ID NO: 4475 - DNA, 25 bp, Artificial Sequence
  Synthetic oligonucleotide
auagcugcuaaauauaaacauucag

SEQ ID NO: 4476 - DNA, 25 bp, Artificial Sequence
  Synthetic oligonucleotide
uagcugcuaaauauaaacauucagt

SEQ ID NO: 4477 - DNA, 25 bp, Artificial Sequence
  Synthetic oligonucleotide
agcugcuaaauauaaacauucagta

SEQ ID NO: 4478 - DNA, 25 bp, Artificial Sequence
  Synthetic oligonucleotide
gcugcuaaauauaaacauucaguag

SEQ ID NO: 4479 - DNA, 25 bp, Artificial Sequence
  Synthetic oligonucleotide
uagugaagaaauguuguuacgaugg

SEQ ID NO: 4480 - DNA, 25 bp, Artificial Sequence
  Synthetic oligonucleotide
agugaagaaauguuguuacgaugga

SEQ ID NO: 4481 - DNA, 25 bp, Artificial Sequence
  Synthetic oligonucleotide
gugaagaaauguuguuacgauggag

SEQ ID NO: 4482 - DNA, 25 bp, Artificial Sequence
  Synthetic oligonucleotide
ugaagaaauguuguuacgauggagc

SEQ ID NO: 4483 - DNA, 25 bp, Artificial Sequence
  Synthetic oligonucleotide
gaagaaauguuguuacgauggagcc

SEQ ID NO: 4484 - DNA, 25 bp, Artificial Sequence
  Synthetic oligonucleotide
aagaaauguuguuacgauggagcct

SEQ ID NO: 4485 - DNA, 25 bp, Artificial Sequence
  Synthetic oligonucleotide
agaaauguuguuacgauggagcctg

SEQ ID NO: 4486 - DNA, 25 bp, Artificial Sequence
  Synthetic oligonucleotide
gaaauguuguuacgauggagccugc

SEQ ID NO: 4487 - DNA, 25 bp, Artificial Sequence
  Synthetic oligonucleotide
aaauguuguuacgauggagccugcg

SEQ ID NO: 4488 - DNA, 25 bp, Artificial Sequence
  Synthetic oligonucleotide
augaugaaaccugugagcagcgagc

SEQ ID NO: 4489 - DNA, 25 bp, Artificial Sequence
  Synthetic oligonucleotide
ugaugaaaccugugagcagcgagct

SEQ ID NO: 4490 - DNA, 25 bp, Artificial Sequence
  Synthetic oligonucleotide
gaugaaaccugugagcagcgagctg

SEQ ID NO: 4491 - DNA, 25 bp, Artificial Sequence
  Synthetic oligonucleotide
augaaaccugugagcagcgagcugc

SEQ ID NO: 4492 - DNA, 25 bp, Artificial Sequence
  Synthetic oligonucleotide
ugaaaccugugagcagcgagcugca

SEQ ID NO: 4493 - DNA, 25 bp, Artificial Sequence
  Synthetic oligonucleotide
gaaaccugugagcagcgagcugcac

SEQ ID NO: 4494 - DNA, 25 bp, Artificial Sequence
  Synthetic oligonucleotide
aaaccugugagcagcgagcugcacg

SEQ ID NO: 4495 - DNA, 25 bp, Artificial Sequence
  Synthetic oligonucleotide
ccugugagcagcgagcugcacggat

SEQ ID NO: 4496 - DNA, 25 bp, Artificial Sequence
  Synthetic oligonucleotide
cugugagcagcgagcugcacggatt

SEQ ID NO: 4497 - DNA, 25 bp, Artificial Sequence
  Synthetic oligonucleotide
ugugagcagcgagcugcacggauta

SEQ ID NO: 4498 - DNA, 25 bp, Artificial Sequence
  Synthetic oligonucleotide
gugagcagcgagcugcacggauuag

SEQ ID NO: 4499 - DNA, 25 bp, Artificial Sequence
  Synthetic oligonucleotide
ugagcagcgagcugcacggauuagt

SEQ ID NO: 4500 - DNA, 25 bp, Artificial Sequence
  Synthetic oligonucleotide
gagcagcgagcugcacggauuagtt

SEQ ID NO: 4501 - DNA, 25 bp, Artificial Sequence
  Synthetic oligonucleotide
agcagcgagcugcacggauuagutt

SEQ ID NO: 4502 - DNA, 25 bp, Artificial Sequence
  Synthetic oligonucleotide
gcagcgagcugcacggauuaguuta

SEQ ID NO: 4503 - DNA, 25 bp, Artificial Sequence
  Synthetic oligonucleotide
cagcgagcugcacggauuaguuuag

SEQ ID NO: 4504 - DNA, 25 bp, Artificial Sequence
  Synthetic oligonucleotide
agcgagcugcacggauuaguuuagg

SEQ ID NO: 4505 - DNA, 25 bp, Artificial Sequence
  Synthetic oligonucleotide
gcgagcugcacggauuaguuuaggg

SEQ ID NO: 4506 - DNA, 25 bp, Artificial Sequence
  Synthetic oligonucleotide
gucgucgcaagccagcuccgugcta

SEQ ID NO: 4507 - DNA, 25 bp, Artificial Sequence
  Synthetic oligonucleotide
ucgucgcaagccagcuccgugcuaa

SEQ ID NO: 4508 - DNA, 25 bp, Artificial Sequence
  Synthetic oligonucleotide
cgucgcaagccagcuccgugcuaat

SEQ ID NO: 4509 - DNA, 25 bp, Artificial Sequence
  Synthetic oligonucleotide
gucgcaagccagcuccgugcuaata

SEQ ID NO: 4510 - DNA, 25 bp, Artificial Sequence
  Synthetic oligonucleotide
ucgcaagccagcuccgugcuaauat

SEQ ID NO: 4511 - DNA, 25 bp, Artificial Sequence
  Synthetic oligonucleotide
cgcaagccagcuccgugcuaauatc

SEQ ID NO: 4512 - DNA, 25 bp, Artificial Sequence
  Synthetic oligonucleotide
gcaagccagcuccgugcuaauauct

SEQ ID NO: 4513 - DNA, 25 bp, Artificial Sequence
  Synthetic oligonucleotide
caagccagcuccgugcuaauauctc

SEQ ID NO: 4514 - DNA, 25 bp, Artificial Sequence
  Synthetic oligonucleotide
aagccagcuccgugcuaauaucuct

SEQ ID NO: 4515 - DNA, 25 bp, Artificial Sequence
  Synthetic oligonucleotide
agccagcuccgugcuaauaucuctc

SEQ ID NO: 4516 - DNA, 25 bp, Artificial Sequence
  Synthetic oligonucleotide
caugaagacccuguuaccaguaagc

SEQ ID NO: 4517 - DNA, 25 bp, Artificial Sequence
  Synthetic oligonucleotide
augaagacccuguuaccaguaagca

SEQ ID NO: 4518 - DNA, 25 bp, Artificial Sequence
  Synthetic oligonucleotide
ugaagacccuguuaccaguaagcaa

SEQ ID NO: 4519 - DNA, 25 bp, Artificial Sequence
  Synthetic oligonucleotide
aagacccuguuaccaguaagcaagc

SEQ ID NO: 4520 - DNA, 25 bp, Artificial Sequence
  Synthetic oligonucleotide
agacccuguuaccaguaagcaagcc

SEQ ID NO: 4521 - DNA, 25 bp, Artificial Sequence
  Synthetic oligonucleotide
gacccuguuaccaguaagcaagcca

SEQ ID NO: 4522 - DNA, 25 bp, Artificial Sequence
  Synthetic oligonucleotide
acccuguuaccaguaagcaagccag

SEQ ID NO: 4523 - DNA, 25 bp, Artificial Sequence
  Synthetic oligonucleotide
cccuguuaccaguaagcaagccaga

SEQ ID NO: 4524 - DNA, 25 bp, Artificial Sequence
  Synthetic oligonucleotide
ccuguuaccaguaagcaagccagaa

SEQ ID NO: 4525 - DNA, 25 bp, Artificial Sequence
  Synthetic oligonucleotide
cuguuaccaguaagcaagccagaaa

SEQ ID NO: 4526 - DNA, 25 bp, Artificial Sequence
  Synthetic oligonucleotide
uguuaccaguaagcaagccagaaat

SEQ ID NO: 4527 - DNA, 25 bp, Artificial Sequence
  Synthetic oligonucleotide
guuaccaguaagcaagccagaaatt

SEQ ID NO: 4528 - DNA, 25 bp, Artificial Sequence
  Synthetic oligonucleotide
uuaccaguaagcaagccagaaautc

SEQ ID NO: 4529 - DNA, 25 bp, Artificial Sequence
  Synthetic oligonucleotide
uaccaguaagcaagccagaaauucg

SEQ ID NO: 4530 - DNA, 25 bp, Artificial Sequence
  Synthetic oligonucleotide
accaguaagcaagccagaaauucgg

SEQ ID NO: 4531 - DNA, 25 bp, Artificial Sequence
  Synthetic oligonucleotide
ccaguaagcaagccagaaauucgga

SEQ ID NO: 4532 - DNA, 25 bp, Artificial Sequence
  Synthetic oligonucleotide
caguaagcaagccagaaauucggag

SEQ ID NO: 4533 - DNA, 25 bp, Artificial Sequence
  Synthetic oligonucleotide
aguaagcaagccagaaauucggagt

SEQ ID NO: 4534 - DNA, 25 bp, Artificial Sequence
  Synthetic oligonucleotide
guaagcaagccagaaauucggagtt

SEQ ID NO: 4535 - DNA, 25 bp, Artificial Sequence
  Synthetic oligonucleotide
uaagcaagccagaaauucggaguta

SEQ ID NO: 4536 - DNA, 25 bp, Artificial Sequence
  Synthetic oligonucleotide
aagcaagccagaaauucggaguuat

SEQ ID NO: 4537 - DNA, 25 bp, Artificial Sequence
  Synthetic oligonucleotide
agcaagccagaaauucggaguuatt

SEQ ID NO: 4538 - DNA, 25 bp, Artificial Sequence
  Synthetic oligonucleotide
gcaagccagaaauucggaguuautt

SEQ ID NO: 4539 - DNA, 25 bp, Artificial Sequence
  Synthetic oligonucleotide
aagccagaaauucggaguuauuutc

SEQ ID NO: 4540 - DNA, 25 bp, Artificial Sequence
  Synthetic oligonucleotide
agccagaaauucggaguuauuuucc

SEQ ID NO: 4541 - DNA, 25 bp, Artificial Sequence
  Synthetic oligonucleotide
gccagaaauucggaguuauuuucca

SEQ ID NO: 4542 - DNA, 25 bp, Artificial Sequence
  Synthetic oligonucleotide
ccagaaauucggaguuauuuuccag

SEQ ID NO: 4543 - DNA, 25 bp, Artificial Sequence
  Synthetic oligonucleotide
cagaaauucggaguuauuuuccaga

SEQ ID NO: 4544 - DNA, 25 bp, Artificial Sequence
  Synthetic oligonucleotide
agaaauucggaguuauuuuccagaa

SEQ ID NO: 4545 - DNA, 25 bp, Artificial Sequence
  Synthetic oligonucleotide
gaaauucggaguuauuuuccagaaa

SEQ ID NO: 4546 - DNA, 25 bp, Artificial Sequence
  Synthetic oligonucleotide
aaauucggaguuauuuuccagaaag

SEQ ID NO: 4547 - DNA, 25 bp, Artificial Sequence
  Synthetic oligonucleotide
aauucggaguuauuuuccagaaagc

SEQ ID NO: 4548 - DNA, 25 bp, Artificial Sequence
  Synthetic oligonucleotide
auucggaguuauuuuccagaaagct

SEQ ID NO: 4549 - DNA, 25 bp, Artificial Sequence
  Synthetic oligonucleotide
uucggaguuauuuuccagaaagctg

SEQ ID NO: 4550 - DNA, 25 bp, Artificial Sequence
  Synthetic oligonucleotide
ucggaguuauuuuccagaaagcugg

SEQ ID NO: 4551 - DNA, 25 bp, Artificial Sequence
  Synthetic oligonucleotide
cggaguuauuuuccagaaagcuggt

SEQ ID NO: 4552 - DNA, 25 bp, Artificial Sequence
  Synthetic oligonucleotide
ggaguuauuuuccagaaagcuggtt

SEQ ID NO: 4553 - DNA, 25 bp, Artificial Sequence
  Synthetic oligonucleotide
gaguuauuuuccagaaagcuggutg

SEQ ID NO: 4554 - DNA, 25 bp, Artificial Sequence
  Synthetic oligonucleotide
aguuauuuuccagaaagcugguugt

SEQ ID NO: 4555 - DNA, 25 bp, Artificial Sequence
  Synthetic oligonucleotide
guuauuuuccagaaagcugguugtg

SEQ ID NO: 4556 - DNA, 25 bp, Artificial Sequence
  Synthetic oligonucleotide
uuauuuuccagaaagcugguugugg

SEQ ID NO: 4557 - DNA, 25 bp, Artificial Sequence
  Synthetic oligonucleotide
uauuuuccagaaagcugguuguggg

SEQ ID NO: 4558 - DNA, 25 bp, Artificial Sequence
  Synthetic oligonucleotide
auuuuccagaaagcugguuguggga

SEQ ID NO: 4559 - DNA, 25 bp, Artificial Sequence
  Synthetic oligonucleotide
ugggaaguucaucuuguucccagaa

SEQ ID NO: 4560 - DNA, 25 bp, Artificial Sequence
  Synthetic oligonucleotide
gggaaguucaucuuguucccagaag

SEQ ID NO: 4561 - DNA, 25 bp, Artificial Sequence
  Synthetic oligonucleotide
ggaaguucaucuuguucccagaaga

SEQ ID NO: 4562 - DNA, 25 bp, Artificial Sequence
  Synthetic oligonucleotide
gaaguucaucuuguucccagaagaa

SEQ ID NO: 4563 - DNA, 25 bp, Artificial Sequence
  Synthetic oligonucleotide
aaguucaucuuguucccagaagaaa

SEQ ID NO: 4564 - DNA, 25 bp, Artificial Sequence
  Synthetic oligonucleotide
aguucaucuuguucccagaagaaaa

SEQ ID NO: 4565 - DNA, 25 bp, Artificial Sequence
  Synthetic oligonucleotide
guucaucuuguucccagaagaaaac

SEQ ID NO: 4566 - DNA, 25 bp, Artificial Sequence
  Synthetic oligonucleotide
uucaucuuguucccagaagaaaaca

SEQ ID NO: 4567 - DNA, 25 bp, Artificial Sequence
  Synthetic oligonucleotide
ucaucuuguucccagaagaaaacag

SEQ ID NO: 4568 - DNA, 25 bp, Artificial Sequence
  Synthetic oligonucleotide
caucuuguucccagaagaaaacagt

SEQ ID NO: 4569 - DNA, 25 bp, Artificial Sequence
  Synthetic oligonucleotide
aucuuguucccagaagaaaacagtt

SEQ ID NO: 4570 - DNA, 25 bp, Artificial Sequence
  Synthetic oligonucleotide
ucuuguucccagaagaaaacagutg

SEQ ID NO: 4571 - DNA, 25 bp, Artificial Sequence
  Synthetic oligonucleotide
cuuguucccagaagaaaacaguugc

SEQ ID NO: 4572 - DNA, 25 bp, Artificial Sequence
  Synthetic oligonucleotide
uuguucccagaagaaaacaguugca

SEQ ID NO: 4573 - DNA, 25 bp, Artificial Sequence
  Synthetic oligonucleotide
uguucccagaagaaaacaguugcag

SEQ ID NO: 4574 - DNA, 25 bp, Artificial Sequence
  Synthetic oligonucleotide
guucccagaagaaaacaguugcagt

SEQ ID NO: 4575 - DNA, 25 bp, Artificial Sequence
  Synthetic oligonucleotide
uucccagaagaaaacaguugcagtt

SEQ ID NO: 4576 - DNA, 25 bp, Artificial Sequence
  Synthetic oligonucleotide
ucccagaagaaaacaguugcagutt

SEQ ID NO: 4577 - DNA, 25 bp, Artificial Sequence
  Synthetic oligonucleotide
cccagaagaaaacaguugcaguutg

SEQ ID NO: 4578 - DNA, 25 bp, Artificial Sequence
  Synthetic oligonucleotide
ccagaagaaaacaguugcaguuugc

SEQ ID NO: 4579 - DNA, 25 bp, Artificial Sequence
  Synthetic oligonucleotide
cagaagaaaacaguugcaguuugcc

SEQ ID NO: 4580 - DNA, 25 bp, Artificial Sequence
  Synthetic oligonucleotide
agaagaaaacaguugcaguuugccc

SEQ ID NO: 4581 - DNA, 25 bp, Artificial Sequence
  Synthetic oligonucleotide
gaagaaaacaguugcaguuugccct

SEQ ID NO: 4582 - DNA, 25 bp, Artificial Sequence
  Synthetic oligonucleotide
aagaaaacaguugcaguuugcccta

SEQ ID NO: 4583 - DNA, 25 bp, Artificial Sequence
  Synthetic oligonucleotide
agaaaacaguugcaguuugcccuac

SEQ ID NO: 4584 - DNA, 25 bp, Artificial Sequence
  Synthetic oligonucleotide
gaaaacaguugcaguuugcccuacc

SEQ ID NO: 4585 - DNA, 25 bp, Artificial Sequence
  Synthetic oligonucleotide
aaaacaguugcaguuugcccuacct

SEQ ID NO: 4586 - DNA, 25 bp, Artificial Sequence
  Synthetic oligonucleotide
aaacaguugcaguuugcccuacctg

SEQ ID NO: 4587 - DNA, 25 bp, Artificial Sequence
  Synthetic oligonucleotide
aacaguugcaguuugcccuaccuga

SEQ ID NO: 4588 - DNA, 25 bp, Artificial Sequence
  Synthetic oligonucleotide
acaguugcaguuugcccuaccugat

SEQ ID NO: 4589 - DNA, 25 bp, Artificial Sequence
  Synthetic oligonucleotide
caguugcaguuugcccuaccugatt

SEQ ID NO: 4590 - DNA, 25 bp, Artificial Sequence
  Synthetic oligonucleotide
aguugcaguuugcccuaccugautc

SEQ ID NO: 4591 - DNA, 25 bp, Artificial Sequence
  Synthetic oligonucleotide
guugcaguuugcccuaccugauuct

SEQ ID NO: 4592 - DNA, 25 bp, Artificial Sequence
  Synthetic oligonucleotide
uugcaguuugcccuaccugauuctc

SEQ ID NO: 4593 - DNA, 25 bp, Artificial Sequence
  Synthetic oligonucleotide
ugcaguuugcccuaccugauucuct

SEQ ID NO: 4594 - DNA, 25 bp, Artificial Sequence
  Synthetic oligonucleotide
gcaguuugcccuaccugauucucta

SEQ ID NO: 4595 - DNA, 25 bp, Artificial Sequence
  Synthetic oligonucleotide
caguuugcccuaccugauucucuaa

SEQ ID NO: 4596 - DNA, 25 bp, Artificial Sequence
  Synthetic oligonucleotide
aguuugcccuaccugauucucuaac

SEQ ID NO: 4597 - DNA, 25 bp, Artificial Sequence
  Synthetic oligonucleotide
guuugcccuaccugauucucuaacc

SEQ ID NO: 4598 - DNA, 25 bp, Artificial Sequence
  Synthetic oligonucleotide
ggcaaagguguucaaagaugucutc

SEQ ID NO: 4599 - DNA, 25 bp, Artificial Sequence
  Synthetic oligonucleotide
gcaaagguguucaaagaugucuucc

SEQ ID NO: 4600 - DNA, 25 bp, Artificial Sequence
  Synthetic oligonucleotide
caaagguguucaaagaugucuucct

SEQ ID NO: 4601 - DNA, 25 bp, Artificial Sequence
  Synthetic oligonucleotide
aaagguguucaaagaugucuucctg

SEQ ID NO: 4602 - DNA, 25 bp, Artificial Sequence
  Synthetic oligonucleotide
aagguguucaaagaugucuuccugg

SEQ ID NO: 4603 - DNA, 25 bp, Artificial Sequence
  Synthetic oligonucleotide
agguguucaaagaugucuuccugga

SEQ ID NO: 4604 - DNA, 25 bp, Artificial Sequence
  Synthetic oligonucleotide
gguguucaaagaugucuuccuggaa

SEQ ID NO: 4605 - DNA, 25 bp, Artificial Sequence
  Synthetic oligonucleotide
guguucaaagaugucuuccuggaaa

SEQ ID NO: 4606 - DNA, 25 bp, Artificial Sequence
  Synthetic oligonucleotide
uguucaaagaugucuuccuggaaat

SEQ ID NO: 4607 - DNA, 25 bp, Artificial Sequence
  Synthetic oligonucleotide
guucaaagaugucuuccuggaaatg

SEQ ID NO: 4608 - DNA, 25 bp, Artificial Sequence
  Synthetic oligonucleotide
uucaaagaugucuuccuggaaauga

SEQ ID NO: 4609 - DNA, 25 bp, Artificial Sequence
  Synthetic oligonucleotide
ucaaagaugucuuccuggaaaugaa

SEQ ID NO: 4610 - DNA, 25 bp, Artificial Sequence
  Synthetic oligonucleotide
caaagaugucuuccuggaaaugaat

SEQ ID NO: 4611 - DNA, 25 bp, Artificial Sequence
  Synthetic oligonucleotide
aaagaugucuuccuggaaaugaata

SEQ ID NO: 4612 - DNA, 25 bp, Artificial Sequence
  Synthetic oligonucleotide
aagaugucuuccuggaaaugaauat

SEQ ID NO: 4613 - DNA, 25 bp, Artificial Sequence
  Synthetic oligonucleotide
agaugucuuccuggaaaugaauata

SEQ ID NO: 4614 - DNA, 25 bp, Artificial Sequence
  Synthetic oligonucleotide
augucuuccuggaaaugaauauacc

SEQ ID NO: 4615 - DNA, 25 bp, Artificial Sequence
  Synthetic oligonucleotide
ugucuuccuggaaaugaauauacca

SEQ ID NO: 4616 - DNA, 25 bp, Artificial Sequence
  Synthetic oligonucleotide
gucuuccuggaaaugaauauaccat

SEQ ID NO: 4617 - DNA, 25 bp, Artificial Sequence
  Synthetic oligonucleotide
ucuuccuggaaaugaauauaccata

SEQ ID NO: 4618 - DNA, 25 bp, Artificial Sequence
  Synthetic oligonucleotide
cuuccuggaaaugaauauaccauat

SEQ ID NO: 4619 - DNA, 25 bp, Artificial Sequence
  Synthetic oligonucleotide
uuccuggaaaugaauauaccauatt

SEQ ID NO: 4620 - DNA, 25 bp, Artificial Sequence
  Synthetic oligonucleotide
uccuggaaaugaauauaccauautc

SEQ ID NO: 4621 - DNA, 25 bp, Artificial Sequence
  Synthetic oligonucleotide
ccuggaaaugaauauaccauauuct

SEQ ID NO: 4622 - DNA, 25 bp, Artificial Sequence
  Synthetic oligonucleotide
uauaccauauucuguuguacgagga

SEQ ID NO: 4623 - DNA, 25 bp, Artificial Sequence
  Synthetic oligonucleotide
auaccauauucuguuguacgaggag

SEQ ID NO: 4624 - DNA, 25 bp, Artificial Sequence
  Synthetic oligonucleotide
uaccauauucuguuguacgaggaga

SEQ ID NO: 4625 - DNA, 25 bp, Artificial Sequence
  Synthetic oligonucleotide
accauauucuguuguacgaggagaa

SEQ ID NO: 4626 - DNA, 25 bp, Artificial Sequence
  Synthetic oligonucleotide
ccauauucuguuguacgaggagaac

SEQ ID NO: 4627 - DNA, 25 bp, Artificial Sequence
  Synthetic oligonucleotide
cauauucuguuguacgaggagaaca

SEQ ID NO: 4628 - DNA, 25 bp, Artificial Sequence
  Synthetic oligonucleotide
auauucuguuguacgaggagaacag

SEQ ID NO: 4629 - DNA, 25 bp, Artificial Sequence
  Synthetic oligonucleotide
uauucuguuguacgaggagaacaga

SEQ ID NO: 4630 - DNA, 25 bp, Artificial Sequence
  Synthetic oligonucleotide
auucuguuguacgaggagaacagat

SEQ ID NO: 4631 - DNA, 25 bp, Artificial Sequence
  Synthetic oligonucleotide
uucuguuguacgaggagaacagatc

SEQ ID NO: 4632 - DNA, 25 bp, Artificial Sequence
  Synthetic oligonucleotide
ucuguuguacgaggagaacagaucc

SEQ ID NO: 4633 - DNA, 25 bp, Artificial Sequence
  Synthetic oligonucleotide
cuguuguacgaggagaacagaucca

SEQ ID NO: 4634 - DNA, 25 bp, Artificial Sequence
  Synthetic oligonucleotide
uguuguacgaggagaacagauccaa

SEQ ID NO: 4635 - DNA, 25 bp, Artificial Sequence
  Synthetic oligonucleotide
gaacuguuuacaacuauaggacutc

SEQ ID NO: 4636 - DNA, 25 bp, Artificial Sequence
  Synthetic oligonucleotide
aacuguuuacaacuauaggacuuct

SEQ ID NO: 4637 - DNA, 25 bp, Artificial Sequence
  Synthetic oligonucleotide
acuguuuacaacuauaggacuuctg

SEQ ID NO: 4638 - DNA, 25 bp, Artificial Sequence
  Synthetic oligonucleotide
cuguuuacaacuauaggacuucugg

SEQ ID NO: 4639 - DNA, 25 bp, Artificial Sequence
  Synthetic oligonucleotide
uguuuacaacuauaggacuucuggg

SEQ ID NO: 4640 - DNA, 25 bp, Artificial Sequence
  Synthetic oligonucleotide
guuuacaacuauaggacuucuggga

SEQ ID NO: 4641 - DNA, 25 bp, Artificial Sequence
  Synthetic oligonucleotide
uuuacaacuauaggacuucugggat

SEQ ID NO: 4642 - DNA, 25 bp, Artificial Sequence
  Synthetic oligonucleotide
uuacaacuauaggacuucugggatg

SEQ ID NO: 4643 - DNA, 25 bp, Artificial Sequence
  Synthetic oligonucleotide
uacaacuauaggacuucugggaugc

SEQ ID NO: 4644 - DNA, 25 bp, Artificial Sequence
  Synthetic oligonucleotide
acaacuauaggacuucugggaugca

SEQ ID NO: 4645 - DNA, 25 bp, Artificial Sequence
  Synthetic oligonucleotide
caacuauaggacuucugggaugcag

SEQ ID NO: 4646 - DNA, 25 bp, Artificial Sequence
  Synthetic oligonucleotide
aacuauaggacuucugggaugcagt

SEQ ID NO: 4647 - DNA, 25 bp, Artificial Sequence
  Synthetic oligonucleotide
acuauaggacuucugggaugcagtt

SEQ ID NO: 4648 - DNA, 25 bp, Artificial Sequence
  Synthetic oligonucleotide
cuauaggacuucugggaugcagutc

SEQ ID NO: 4649 - DNA, 25 bp, Artificial Sequence
  Synthetic oligonucleotide
uauaggacuucugggaugcaguuct

SEQ ID NO: 4650 - DNA, 25 bp, Artificial Sequence
  Synthetic oligonucleotide
auaggacuucugggaugcaguuctg

SEQ ID NO: 4651 - DNA, 25 bp, Artificial Sequence
  Synthetic oligonucleotide
uaggacuucugggaugcaguucugt

SEQ ID NO: 4652 - DNA, 25 bp, Artificial Sequence
  Synthetic oligonucleotide
aggacuucugggaugcaguucugtg

SEQ ID NO: 4653 - DNA, 25 bp, Artificial Sequence
  Synthetic oligonucleotide
aaugucugcuguggagggaaucugc

SEQ ID NO: 4654 - DNA, 25 bp, Artificial Sequence
  Synthetic oligonucleotide
augucugcuguggagggaaucugca

SEQ ID NO: 4655 - DNA, 25 bp, Artificial Sequence
  Synthetic oligonucleotide
ugucugcuguggagggaaucugcac

SEQ ID NO: 4656 - DNA, 25 bp, Artificial Sequence
  Synthetic oligonucleotide
gucugcuguggagggaaucugcact

SEQ ID NO: 4657 - DNA, 25 bp, Artificial Sequence
  Synthetic oligonucleotide
ucugcuguggagggaaucugcactt

SEQ ID NO: 4658 - DNA, 25 bp, Artificial Sequence
  Synthetic oligonucleotide
cugcuguggagggaaucugcacutc

SEQ ID NO: 4659 - DNA, 25 bp, Artificial Sequence
  Synthetic oligonucleotide
ugcuguggagggaaucugcacuucg

SEQ ID NO: 4660 - DNA, 25 bp, Artificial Sequence
  Synthetic oligonucleotide
gcuguggagggaaucugcacuucgg

SEQ ID NO: 4661 - DNA, 25 bp, Artificial Sequence
  Synthetic oligonucleotide
cuguggagggaaucugcacuucgga

SEQ ID NO: 4662 - DNA, 25 bp, Artificial Sequence
  Synthetic oligonucleotide
uguggagggaaucugcacuucggaa

SEQ ID NO: 4663 - DNA, 25 bp, Artificial Sequence
  Synthetic oligonucleotide
guggagggaaucugcacuucggaaa

SEQ ID NO: 4664 - DNA, 25 bp, Artificial Sequence
  Synthetic oligonucleotide
uggagggaaucugcacuucggaaag

SEQ ID NO: 4665 - DNA, 25 bp, Artificial Sequence
  Synthetic oligonucleotide
gaaagcccagucauugaucaucagg

SEQ ID NO: 4666 - DNA, 25 bp, Artificial Sequence
  Synthetic oligonucleotide
aaagcccagucauugaucaucaggg

SEQ ID NO: 4667 - DNA, 25 bp, Artificial Sequence
  Synthetic oligonucleotide
aagcccagucauugaucaucagggc

SEQ ID NO: 4668 - DNA, 25 bp, Artificial Sequence
  Synthetic oligonucleotide
agcccagucauugaucaucagggca

SEQ ID NO: 4669 - DNA, 25 bp, Artificial Sequence
  Synthetic oligonucleotide
gcccagucauugaucaucagggcac

SEQ ID NO: 4670 - DNA, 25 bp, Artificial Sequence
  Synthetic oligonucleotide
cccagucauugaucaucagggcaca

SEQ ID NO: 4671 - DNA, 25 bp, Artificial Sequence
  Synthetic oligonucleotide
ccagucauugaucaucagggcacaa

SEQ ID NO: 4672 - DNA, 25 bp, Artificial Sequence
  Synthetic oligonucleotide
cagucauugaucaucagggcacaaa

SEQ ID NO: 4673 - DNA, 25 bp, Artificial Sequence
  Synthetic oligonucleotide
agucauugaucaucagggcacaaag

SEQ ID NO: 4674 - DNA, 25 bp, Artificial Sequence
  Synthetic oligonucleotide
gucauugaucaucagggcacaaagt

SEQ ID NO: 4675 - DNA, 25 bp, Artificial Sequence
  Synthetic oligonucleotide
ucauugaucaucagggcacaaagtc

SEQ ID NO: 4676 - DNA, 25 bp, Artificial Sequence
  Synthetic oligonucleotide
cauugaucaucagggcacaaagucc

SEQ ID NO: 4677 - DNA, 25 bp, Artificial Sequence
  Synthetic oligonucleotide
auugaucaucagggcacaaagucct

SEQ ID NO: 4678 - DNA, 25 bp, Artificial Sequence
  Synthetic oligonucleotide
uugaucaucagggcacaaagucctc

SEQ ID NO: 4679 - DNA, 25 bp, Artificial Sequence
  Synthetic oligonucleotide
ugaucaucagggcacaaaguccucc

SEQ ID NO: 4680 - DNA, 25 bp, Artificial Sequence
  Synthetic oligonucleotide
gaucaucagggcacaaaguccucca

SEQ ID NO: 4681 - DNA, 25 bp, Artificial Sequence
  Synthetic oligonucleotide
aucaucagggcacaaaguccuccaa

SEQ ID NO: 4682 - DNA, 25 bp, Artificial Sequence
  Synthetic oligonucleotide
ucaucagggcacaaaguccuccaaa

SEQ ID NO: 4683 - DNA, 25 bp, Artificial Sequence
  Synthetic oligonucleotide
caucagggcacaaaguccuccaaat

SEQ ID NO: 4684 - DNA, 25 bp, Artificial Sequence
  Synthetic oligonucleotide
aucagggcacaaaguccuccaaatg

SEQ ID NO: 4685 - DNA, 25 bp, Artificial Sequence
  Synthetic oligonucleotide
ucagggcacaaaguccuccaaaugt

SEQ ID NO: 4686 - DNA, 25 bp, Artificial Sequence
  Synthetic oligonucleotide
cagggcacaaaguccuccaaaugtg

SEQ ID NO: 4687 - DNA, 25 bp, Artificial Sequence
  Synthetic oligonucleotide
agaaaguagagggcuccuccaguca

SEQ ID NO: 4688 - DNA, 25 bp, Artificial Sequence
  Synthetic oligonucleotide
acugugcuuccucuggaaauuggcc

SEQ ID NO: 4689 - DNA, 25 bp, Artificial Sequence
  Synthetic oligonucleotide
cugugcuuccucuggaaauuggcct

SEQ ID NO: 4690 - DNA, 25 bp, Artificial Sequence
  Synthetic oligonucleotide
ugugcuuccucuggaaauuggcctt

SEQ ID NO: 4691 - DNA, 25 bp, Artificial Sequence
  Synthetic oligonucleotide
gugcuuccucuggaaauuggccutc

SEQ ID NO: 4692 - DNA, 25 bp, Artificial Sequence
  Synthetic oligonucleotide
guuuggaaaagaaaucuuaguaaaa

SEQ ID NO: 4693 - DNA, 25 bp, Artificial Sequence
  Synthetic oligonucleotide
uuuggaaaagaaaucuuaguaaaaa

SEQ ID NO: 4694 - DNA, 25 bp, Artificial Sequence
  Synthetic oligonucleotide
uuggaaaagaaaucuuaguaaaaac

SEQ ID NO: 4695 - DNA, 25 bp, Artificial Sequence
  Synthetic oligonucleotide
uggaaaagaaaucuuaguaaaaaca

SEQ ID NO: 4696 - DNA, 25 bp, Artificial Sequence
  Synthetic oligonucleotide
ggaaaagaaaucuuaguaaaaacat

SEQ ID NO: 4697 - DNA, 25 bp, Artificial Sequence
  Synthetic oligonucleotide
gaaaagaaaucuuaguaaaaacatt

SEQ ID NO: 4698 - DNA, 25 bp, Artificial Sequence
  Synthetic oligonucleotide
aaaagaaaucuuaguaaaaacauta

SEQ ID NO: 4699 - DNA, 25 bp, Artificial Sequence
  Synthetic oligonucleotide
uuacgaguggugccagaagguguca

SEQ ID NO: 4700 - DNA, 25 bp, Artificial Sequence
  Synthetic oligonucleotide
uacgaguggugccagaaggugucaa

SEQ ID NO: 4701 - DNA, 25 bp, Artificial Sequence
  Synthetic oligonucleotide
acgaguggugccagaaggugucaaa

SEQ ID NO: 4702 - DNA, 25 bp, Artificial Sequence
  Synthetic oligonucleotide
cgaguggugccagaaggugucaaaa

SEQ ID NO: 4703 - DNA, 25 bp, Artificial Sequence
  Synthetic oligonucleotide
gaguggugccagaaggugucaaaag

SEQ ID NO: 4704 - DNA, 25 bp, Artificial Sequence
  Synthetic oligonucleotide
aguggugccagaaggugucaaaagg

SEQ ID NO: 4705 - DNA, 25 bp, Artificial Sequence
  Synthetic oligonucleotide
guggugccagaaggugucaaaaggg

SEQ ID NO: 4706 - DNA, 25 bp, Artificial Sequence
  Synthetic oligonucleotide
uggugccagaaggugucaaaaggga

SEQ ID NO: 4707 - DNA, 25 bp, Artificial Sequence
  Synthetic oligonucleotide
ggugccagaaggugucaaaagggaa

SEQ ID NO: 4708 - DNA, 25 bp, Artificial Sequence
  Synthetic oligonucleotide
gugccagaaggugucaaaagggaaa

SEQ ID NO: 4709 - DNA, 25 bp, Artificial Sequence
  Synthetic oligonucleotide
ugccagaaggugucaaaagggaaag

SEQ ID NO: 4710 - DNA, 25 bp, Artificial Sequence
  Synthetic oligonucleotide
gccagaaggugucaaaagggaaagc

SEQ ID NO: 4711 - DNA, 25 bp, Artificial Sequence
  Synthetic oligonucleotide
ccagaaggugucaaaagggaaagct

SEQ ID NO: 4712 - DNA, 25 bp, Artificial Sequence
  Synthetic oligonucleotide
cagaaggugucaaaagggaaagcta

SEQ ID NO: 4713 - DNA, 25 bp, Artificial Sequence
  Synthetic oligonucleotide
agaaggugucaaaagggaaagcuat

SEQ ID NO: 4714 - DNA, 25 bp, Artificial Sequence
  Synthetic oligonucleotide
gaaggugucaaaagggaaagcuatt

SEQ ID NO: 4715 - DNA, 25 bp, Artificial Sequence
  Synthetic oligonucleotide
aaggugucaaaagggaaagcuautc

SEQ ID NO: 4716 - DNA, 25 bp, Artificial Sequence
  Synthetic oligonucleotide
aggugucaaaagggaaagcuauuct

SEQ ID NO: 4717 - DNA, 25 bp, Artificial Sequence
  Synthetic oligonucleotide
ggugucaaaagggaaagcuauuctg

SEQ ID NO: 4718 - DNA, 25 bp, Artificial Sequence
  Synthetic oligonucleotide
gugucaaaagggaaagcuauucugg

SEQ ID NO: 4719 - DNA, 25 bp, Artificial Sequence
  Synthetic oligonucleotide
ugucaaaagggaaagcuauucuggt

SEQ ID NO: 4720 - DNA, 25 bp, Artificial Sequence
  Synthetic oligonucleotide
gucaaaagggaaagcuauucuggtg

SEQ ID NO: 4721 - DNA, 25 bp, Artificial Sequence
  Synthetic oligonucleotide
ucaaaagggaaagcuauucuggugt

SEQ ID NO: 4722 - DNA, 25 bp, Artificial Sequence
  Synthetic oligonucleotide
caaaagggaaagcuauucuggugtt

SEQ ID NO: 4723 - DNA, 25 bp, Artificial Sequence
  Synthetic oligonucleotide
aaaagggaaagcuauucugguguta

SEQ ID NO: 4724 - DNA, 25 bp, Artificial Sequence
  Synthetic oligonucleotide
aaagggaaagcuauucugguguuac

SEQ ID NO: 4725 - DNA, 25 bp, Artificial Sequence
  Synthetic oligonucleotide
aagggaaagcuauucugguguuact

SEQ ID NO: 4726 - DNA, 25 bp, Artificial Sequence
  Synthetic oligonucleotide
uuacuuuggauccuagggguauuta

SEQ ID NO: 4727 - DNA, 25 bp, Artificial Sequence
  Synthetic oligonucleotide
uacuuuggauccuagggguauuuat

SEQ ID NO: 4728 - DNA, 25 bp, Artificial Sequence
  Synthetic oligonucleotide
acuuuggauccuagggguauuuatg

SEQ ID NO: 4729 - DNA, 25 bp, Artificial Sequence
  Synthetic oligonucleotide
cuuuggauccuagggguauuuaugg

SEQ ID NO: 4730 - DNA, 25 bp, Artificial Sequence
  Synthetic oligonucleotide
uuuggauccuagggguauuuauggt

SEQ ID NO: 4731 - DNA, 25 bp, Artificial Sequence
  Synthetic oligonucleotide
uuggauccuagggguauuuauggta

SEQ ID NO: 4732 - DNA, 25 bp, Artificial Sequence
  Synthetic oligonucleotide
uggauccuagggguauuuaugguac

SEQ ID NO: 4733 - DNA, 25 bp, Artificial Sequence
  Synthetic oligonucleotide
ggauccuagggguauuuaugguacc

SEQ ID NO: 4734 - DNA, 25 bp, Artificial Sequence
  Synthetic oligonucleotide
gauccuagggguauuuaugguacca

SEQ ID NO: 4735 - DNA, 25 bp, Artificial Sequence
  Synthetic oligonucleotide
cgaaaggaguucccauacaggauac

SEQ ID NO: 4736 - DNA, 25 bp, Artificial Sequence
  Synthetic oligonucleotide
gaaaggaguucccauacaggauacc

SEQ ID NO: 4737 - DNA, 25 bp, Artificial Sequence
  Synthetic oligonucleotide
aaaggaguucccauacaggauaccc

SEQ ID NO: 4738 - DNA, 25 bp, Artificial Sequence
  Synthetic oligonucleotide
aaggaguucccauacaggauaccct

SEQ ID NO: 4739 - DNA, 25 bp, Artificial Sequence
  Synthetic oligonucleotide
aggaguucccauacaggauaccctt

SEQ ID NO: 4740 - DNA, 25 bp, Artificial Sequence
  Synthetic oligonucleotide
ggaguucccauacaggauacccuta

SEQ ID NO: 4741 - DNA, 25 bp, Artificial Sequence
  Synthetic oligonucleotide
gaguucccauacaggauacccuuag

SEQ ID NO: 4742 - DNA, 25 bp, Artificial Sequence
  Synthetic oligonucleotide
aguucccauacaggauacccuuaga

SEQ ID NO: 4743 - DNA, 25 bp, Artificial Sequence
  Synthetic oligonucleotide
uuagauuugguccccaaaacagaaa

SEQ ID NO: 4744 - DNA, 25 bp, Artificial Sequence
  Synthetic oligonucleotide
uagauuugguccccaaaacagaaat

SEQ ID NO: 4745 - DNA, 25 bp, Artificial Sequence
  Synthetic oligonucleotide
agauuugguccccaaaacagaaatc

SEQ ID NO: 4746 - DNA, 25 bp, Artificial Sequence
  Synthetic oligonucleotide
gauuugguccccaaaacagaaauca

SEQ ID NO: 4747 - DNA, 25 bp, Artificial Sequence
  Synthetic oligonucleotide
auuugguccccaaaacagaaaucaa

SEQ ID NO: 4748 - DNA, 25 bp, Artificial Sequence
  Synthetic oligonucleotide
uuugguccccaaaacagaaaucaaa

SEQ ID NO: 4749 - DNA, 25 bp, Artificial Sequence
  Synthetic oligonucleotide
uugguccccaaaacagaaaucaaaa

SEQ ID NO: 4750 - DNA, 25 bp, Artificial Sequence
  Synthetic oligonucleotide
ugguccccaaaacagaaaucaaaag

SEQ ID NO: 4751 - DNA, 25 bp, Artificial Sequence
  Synthetic oligonucleotide
gguccccaaaacagaaaucaaaagg

SEQ ID NO: 4752 - DNA, 25 bp, Artificial Sequence
  Synthetic oligonucleotide
guccccaaaacagaaaucaaaagga

SEQ ID NO: 4753 - DNA, 25 bp, Artificial Sequence
  Synthetic oligonucleotide
uccccaaaacagaaaucaaaaggat

SEQ ID NO: 4754 - DNA, 25 bp, Artificial Sequence
  Synthetic oligonucleotide
ccccaaaacagaaaucaaaaggatt

SEQ ID NO: 4755 - DNA, 25 bp, Artificial Sequence
  Synthetic oligonucleotide
cccaaaacagaaaucaaaaggautt

SEQ ID NO: 4756 - DNA, 25 bp, Artificial Sequence
  Synthetic oligonucleotide
ccaaaacagaaaucaaaaggauutt

SEQ ID NO: 4757 - DNA, 25 bp, Artificial Sequence
  Synthetic oligonucleotide
caaaacagaaaucaaaaggauuutg

SEQ ID NO: 4758 - DNA, 25 bp, Artificial Sequence
  Synthetic oligonucleotide
aaaacagaaaucaaaaggauuuuga

SEQ ID NO: 4759 - DNA, 25 bp, Artificial Sequence
  Synthetic oligonucleotide
aaacagaaaucaaaaggauuuugag

SEQ ID NO: 4760 - DNA, 25 bp, Artificial Sequence
  Synthetic oligonucleotide
aacagaaaucaaaaggauuuugagt

SEQ ID NO: 4761 - DNA, 25 bp, Artificial Sequence
  Synthetic oligonucleotide
acagaaaucaaaaggauuuugagtg

SEQ ID NO: 4762 - DNA, 25 bp, Artificial Sequence
  Synthetic oligonucleotide
cagaaaucaaaaggauuuugagugt

SEQ ID NO: 4763 - DNA, 25 bp, Artificial Sequence
  Synthetic oligonucleotide
aaaucaaaaggauuuugaguguaaa

SEQ ID NO: 4764 - DNA, 25 bp, Artificial Sequence
  Synthetic oligonucleotide
aaucaaaaggauuuugaguguaaaa

SEQ ID NO: 4765 - DNA, 25 bp, Artificial Sequence
  Synthetic oligonucleotide
aucaaaaggauuuugaguguaaaag

SEQ ID NO: 4766 - DNA, 25 bp, Artificial Sequence
  Synthetic oligonucleotide
ucaaaaggauuuugaguguaaaagg

SEQ ID NO: 4767 - DNA, 25 bp, Artificial Sequence
  Synthetic oligonucleotide
aaaaggauuuugaguguaaaaggac

SEQ ID NO: 4768 - DNA, 25 bp, Artificial Sequence
  Synthetic oligonucleotide
aaaggauuuugaguguaaaaggact

SEQ ID NO: 4769 - DNA, 25 bp, Artificial Sequence
  Synthetic oligonucleotide
aaggauuuugaguguaaaaggactg

SEQ ID NO: 4770 - DNA, 25 bp, Artificial Sequence
  Synthetic oligonucleotide
aggauuuugaguguaaaaggacugc

SEQ ID NO: 4771 - DNA, 25 bp, Artificial Sequence
  Synthetic oligonucleotide
ggauuuugaguguaaaaggacugct

SEQ ID NO: 4772 - DNA, 25 bp, Artificial Sequence
  Synthetic oligonucleotide
gauuuugaguguaaaaggacugctt

SEQ ID NO: 4773 - DNA, 25 bp, Artificial Sequence
  Synthetic oligonucleotide
auuuugaguguaaaaggacugcutg

SEQ ID NO: 4774 - DNA, 25 bp, Artificial Sequence
  Synthetic oligonucleotide
uuuugaguguaaaaggacugcuugt

SEQ ID NO: 4775 - DNA, 25 bp, Artificial Sequence
  Synthetic oligonucleotide
uuugaguguaaaaggacugcuugta

SEQ ID NO: 4776 - DNA, 25 bp, Artificial Sequence
  Synthetic oligonucleotide
uugaguguaaaaggacugcuuguag

SEQ ID NO: 4777 - DNA, 25 bp, Artificial Sequence
  Synthetic oligonucleotide
ugaguguaaaaggacugcuuguagg

SEQ ID NO: 4778 - DNA, 25 bp, Artificial Sequence
  Synthetic oligonucleotide
gaguguaaaaggacugcuuguaggt

SEQ ID NO: 4779 - DNA, 25 bp, Artificial Sequence
  Synthetic oligonucleotide
aguguaaaaggacugcuuguaggtg

SEQ ID NO: 4780 - DNA, 25 bp, Artificial Sequence
  Synthetic oligonucleotide
guguaaaaggacugcuuguagguga

SEQ ID NO: 4781 - DNA, 25 bp, Artificial Sequence
  Synthetic oligonucleotide
uguaaaaggacugcuuguaggugag

SEQ ID NO: 4782 - DNA, 25 bp, Artificial Sequence
  Synthetic oligonucleotide
guaaaaggacugcuuguaggugaga

SEQ ID NO: 4783 - DNA, 25 bp, Artificial Sequence
  Synthetic oligonucleotide
uaaaaggacugcuuguaggugagat

SEQ ID NO: 4784 - DNA, 25 bp, Artificial Sequence
  Synthetic oligonucleotide
aaaaggacugcuuguaggugagatc

SEQ ID NO: 4785 - DNA, 25 bp, Artificial Sequence
  Synthetic oligonucleotide
aaaggacugcuuguaggugagauct

SEQ ID NO: 4786 - DNA, 25 bp, Artificial Sequence
  Synthetic oligonucleotide
aaggacugcuuguaggugagauctt

SEQ ID NO: 4787 - DNA, 25 bp, Artificial Sequence
  Synthetic oligonucleotide
aggacugcuuguaggugagaucutg

SEQ ID NO: 4788 - DNA, 25 bp, Artificial Sequence
  Synthetic oligonucleotide
ggacugcuuguaggugagaucuugt

SEQ ID NO: 4789 - DNA, 25 bp, Artificial Sequence
  Synthetic oligonucleotide
gacugcuuguaggugagaucuugtc

SEQ ID NO: 4790 - DNA, 25 bp, Artificial Sequence
  Synthetic oligonucleotide
acugcuuguaggugagaucuuguct

SEQ ID NO: 4791 - DNA, 25 bp, Artificial Sequence
  Synthetic oligonucleotide
cugcuuguaggugagaucuuguctg

SEQ ID NO: 4792 - DNA, 25 bp, Artificial Sequence
  Synthetic oligonucleotide
ugcuuguaggugagaucuugucugc

SEQ ID NO: 4793 - DNA, 25 bp, Artificial Sequence
  Synthetic oligonucleotide
gcuuguaggugagaucuugucugca

SEQ ID NO: 4794 - DNA, 25 bp, Artificial Sequence
  Synthetic oligonucleotide
cuuguaggugagaucuugucugcag

SEQ ID NO: 4795 - DNA, 25 bp, Artificial Sequence
  Synthetic oligonucleotide
uuguaggugagaucuugucugcagt

SEQ ID NO: 4796 - DNA, 25 bp, Artificial Sequence
  Synthetic oligonucleotide
uguaggugagaucuugucugcagtt

SEQ ID NO: 4797 - DNA, 25 bp, Artificial Sequence
  Synthetic oligonucleotide
guaggugagaucuugucugcagutc

SEQ ID NO: 4798 - DNA, 25 bp, Artificial Sequence
  Synthetic oligonucleotide
uaggugagaucuugucugcaguuct

SEQ ID NO: 4799 - DNA, 25 bp, Artificial Sequence
  Synthetic oligonucleotide
aggugagaucuugucugcaguucta

SEQ ID NO: 4800 - DNA, 25 bp, Artificial Sequence
  Synthetic oligonucleotide
ggugagaucuugucugcaguucuaa

SEQ ID NO: 4801 - DNA, 25 bp, Artificial Sequence
  Synthetic oligonucleotide
gugagaucuugucugcaguucuaag

SEQ ID NO: 4802 - DNA, 25 bp, Artificial Sequence
  Synthetic oligonucleotide
ugagaucuugucugcaguucuaagt

SEQ ID NO: 4803 - DNA, 25 bp, Artificial Sequence
  Synthetic oligonucleotide
gagaucuugucugcaguucuaagtc

SEQ ID NO: 4804 - DNA, 25 bp, Artificial Sequence
  Synthetic oligonucleotide
agaucuugucugcaguucuaaguca

SEQ ID NO: 4805 - DNA, 25 bp, Artificial Sequence
  Synthetic oligonucleotide
gaucuugucugcaguucuaagucag

SEQ ID NO: 4806 - DNA, 25 bp, Artificial Sequence
  Synthetic oligonucleotide
aucuugucugcaguucuaagucagg

SEQ ID NO: 4807 - DNA, 25 bp, Artificial Sequence
  Synthetic oligonucleotide
ucuugucugcaguucuaagucagga

SEQ ID NO: 4808 - DNA, 25 bp, Artificial Sequence
  Synthetic oligonucleotide
cuugucugcaguucuaagucaggaa

SEQ ID NO: 4809 - DNA, 25 bp, Artificial Sequence
  Synthetic oligonucleotide
uugucugcaguucuaagucaggaag

SEQ ID NO: 4810 - DNA, 25 bp, Artificial Sequence
  Synthetic oligonucleotide
ggaaggcaucaauauccuaacccac

SEQ ID NO: 4811 - DNA, 25 bp, Artificial Sequence
  Synthetic oligonucleotide
gaaggcaucaauauccuaacccacc

SEQ ID NO: 4812 - DNA, 25 bp, Artificial Sequence
  Synthetic oligonucleotide
aaggcaucaauauccuaacccacct

SEQ ID NO: 4813 - DNA, 25 bp, Artificial Sequence
  Synthetic oligonucleotide
aggcaucaauauccuaacccacctc

SEQ ID NO: 4814 - DNA, 25 bp, Artificial Sequence
  Synthetic oligonucleotide
ggcaucaauauccuaacccaccucc

SEQ ID NO: 4815 - DNA, 25 bp, Artificial Sequence
  Synthetic oligonucleotide
gcaucaauauccuaacccaccuccc

SEQ ID NO: 4816 - DNA, 25 bp, Artificial Sequence
  Synthetic oligonucleotide
caucaauauccuaacccaccucccc

SEQ ID NO: 4817 - DNA, 25 bp, Artificial Sequence
  Synthetic oligonucleotide
aucaauauccuaacccaccucccca

SEQ ID NO: 4818 - DNA, 25 bp, Artificial Sequence
  Synthetic oligonucleotide
ucaauauccuaacccaccuccccaa

SEQ ID NO: 4819 - DNA, 25 bp, Artificial Sequence
  Synthetic oligonucleotide
caauauccuaacccaccuccccaaa

SEQ ID NO: 4820 - DNA, 25 bp, Artificial Sequence
  Synthetic oligonucleotide
aauauccuaacccaccuccccaaag

SEQ ID NO: 4821 - DNA, 25 bp, Artificial Sequence
  Synthetic oligonucleotide
auauccuaacccaccuccccaaagg

SEQ ID NO: 4822 - DNA, 25 bp, Artificial Sequence
  Synthetic oligonucleotide
uauccuaacccaccuccccaaaggg

SEQ ID NO: 4823 - DNA, 25 bp, Artificial Sequence
  Synthetic oligonucleotide
aacccaccuccccaaagggagugca

SEQ ID NO: 4824 - DNA, 25 bp, Artificial Sequence
  Synthetic oligonucleotide
acccaccuccccaaagggagugcag

SEQ ID NO: 4825 - DNA, 25 bp, Artificial Sequence
  Synthetic oligonucleotide
cccaccuccccaaagggagugcaga

SEQ ID NO: 4826 - DNA, 25 bp, Artificial Sequence
  Synthetic oligonucleotide
gaggcggagcugaugagcguugucc

SEQ ID NO: 4827 - DNA, 25 bp, Artificial Sequence
  Synthetic oligonucleotide
gcggagcugaugagcguugucccag

SEQ ID NO: 4828 - DNA, 25 bp, Artificial Sequence
  Synthetic oligonucleotide
cggagcugaugagcguugucccagt

SEQ ID NO: 4829 - DNA, 25 bp, Artificial Sequence
  Synthetic oligonucleotide
ggagcugaugagcguugucccagta

SEQ ID NO: 4830 - DNA, 25 bp, Artificial Sequence
  Synthetic oligonucleotide
gagcugaugagcguugucccaguat

SEQ ID NO: 4831 - DNA, 25 bp, Artificial Sequence
  Synthetic oligonucleotide
agcugaugagcguugucccaguatt

SEQ ID NO: 4832 - DNA, 25 bp, Artificial Sequence
  Synthetic oligonucleotide
gcugaugagcguugucccaguautc

SEQ ID NO: 4833 - DNA, 25 bp, Artificial Sequence
  Synthetic oligonucleotide
cugaugagcguugucccaguauuct

SEQ ID NO: 4834 - DNA, 25 bp, Artificial Sequence
  Synthetic oligonucleotide
ugaugagcguugucccaguauucta

SEQ ID NO: 4835 - DNA, 25 bp, Artificial Sequence
  Synthetic oligonucleotide
gaugagcguugucccaguauucuat

SEQ ID NO: 4836 - DNA, 25 bp, Artificial Sequence
  Synthetic oligonucleotide
augagcguugucccaguauucuatg

SEQ ID NO: 4837 - DNA, 25 bp, Artificial Sequence
  Synthetic oligonucleotide
ugagcguugucccaguauucuaugt

SEQ ID NO: 4838 - DNA, 25 bp, Artificial Sequence
  Synthetic oligonucleotide
gagcguugucccaguauucuaugtt

SEQ ID NO: 4839 - DNA, 25 bp, Artificial Sequence
  Synthetic oligonucleotide
agcguugucccaguauucuaugutt

SEQ ID NO: 4840 - DNA, 25 bp, Artificial Sequence
  Synthetic oligonucleotide
gcguugucccaguauucuauguutt

SEQ ID NO: 4841 - DNA, 25 bp, Artificial Sequence
  Synthetic oligonucleotide
cguugucccaguauucuauguuutt

SEQ ID NO: 4842 - DNA, 25 bp, Artificial Sequence
  Synthetic oligonucleotide
guugucccaguauucuauguuuutc

SEQ ID NO: 4843 - DNA, 25 bp, Artificial Sequence
  Synthetic oligonucleotide
uugucccaguauucuauguuuuuca

SEQ ID NO: 4844 - DNA, 25 bp, Artificial Sequence
  Synthetic oligonucleotide
ugucccaguauucuauguuuuucac

SEQ ID NO: 4845 - DNA, 25 bp, Artificial Sequence
  Synthetic oligonucleotide
gucccaguauucuauguuuuucact

SEQ ID NO: 4846 - DNA, 25 bp, Artificial Sequence
  Synthetic oligonucleotide
ucccaguauucuauguuuuucacta

SEQ ID NO: 4847 - DNA, 25 bp, Artificial Sequence
  Synthetic oligonucleotide
cccaguauucuauguuuuucacuac

SEQ ID NO: 4848 - DNA, 25 bp, Artificial Sequence
  Synthetic oligonucleotide
caguauucuauguuuuucacuacct

SEQ ID NO: 4849 - DNA, 25 bp, Artificial Sequence
  Synthetic oligonucleotide
aguauucuauguuuuucacuacctg

SEQ ID NO: 4850 - DNA, 25 bp, Artificial Sequence
  Synthetic oligonucleotide
guauucuauguuuuucacuaccugg

SEQ ID NO: 4851 - DNA, 25 bp, Artificial Sequence
  Synthetic oligonucleotide
uauucuauguuuuucacuaccugga

SEQ ID NO: 4852 - DNA, 25 bp, Artificial Sequence
  Synthetic oligonucleotide
auucuauguuuuucacuaccuggaa

SEQ ID NO: 4853 - DNA, 25 bp, Artificial Sequence
  Synthetic oligonucleotide
uucuauguuuuucacuaccuggaaa

SEQ ID NO: 4854 - DNA, 25 bp, Artificial Sequence
  Synthetic oligonucleotide
ucuauguuuuucacuaccuggaaac

SEQ ID NO: 4855 - DNA, 25 bp, Artificial Sequence
  Synthetic oligonucleotide
cuauguuuuucacuaccuggaaaca

SEQ ID NO: 4856 - DNA, 25 bp, Artificial Sequence
  Synthetic oligonucleotide
uauguuuuucacuaccuggaaacag

SEQ ID NO: 4857 - DNA, 25 bp, Artificial Sequence
  Synthetic oligonucleotide
auguuuuucacuaccuggaaacagg

SEQ ID NO: 4858 - DNA, 25 bp, Artificial Sequence
  Synthetic oligonucleotide
uguuuuucacuaccuggaaacagga

SEQ ID NO: 4859 - DNA, 25 bp, Artificial Sequence
  Synthetic oligonucleotide
guuuuucacuaccuggaaacaggaa

SEQ ID NO: 4860 - DNA, 25 bp, Artificial Sequence
  Synthetic oligonucleotide
uuuuucacuaccuggaaacaggaaa

SEQ ID NO: 4861 - DNA, 25 bp, Artificial Sequence
  Synthetic oligonucleotide
uuuucacuaccuggaaacaggaaat

SEQ ID NO: 4862 - DNA, 25 bp, Artificial Sequence
  Synthetic oligonucleotide
uuucacuaccuggaaacaggaaatc

SEQ ID NO: 4863 - DNA, 25 bp, Artificial Sequence
  Synthetic oligonucleotide
uucacuaccuggaaacaggaaauca

SEQ ID NO: 4864 - DNA, 25 bp, Artificial Sequence
  Synthetic oligonucleotide
ucacuaccuggaaacaggaaaucat

SEQ ID NO: 4865 - DNA, 25 bp, Artificial Sequence
  Synthetic oligonucleotide
cacuaccuggaaacaggaaaucatt

SEQ ID NO: 4866 - DNA, 25 bp, Artificial Sequence
  Synthetic oligonucleotide
acuaccuggaaacaggaaaucautg

SEQ ID NO: 4867 - DNA, 25 bp, Artificial Sequence
  Synthetic oligonucleotide
cuaccuggaaacaggaaaucauugg

SEQ ID NO: 4868 - DNA, 25 bp, Artificial Sequence
  Synthetic oligonucleotide
uaccuggaaacaggaaaucauugga

SEQ ID NO: 4869 - DNA, 25 bp, Artificial Sequence
  Synthetic oligonucleotide
accuggaaacaggaaaucauuggaa

SEQ ID NO: 4870 - DNA, 25 bp, Artificial Sequence
  Synthetic oligonucleotide
ccuggaaacaggaaaucauuggaac

SEQ ID NO: 4871 - DNA, 25 bp, Artificial Sequence
  Synthetic oligonucleotide
cuggaaacaggaaaucauuggaaca

SEQ ID NO: 4872 - DNA, 25 bp, Artificial Sequence
  Synthetic oligonucleotide
uggaaacaggaaaucauuggaacat

SEQ ID NO: 4873 - DNA, 25 bp, Artificial Sequence
  Synthetic oligonucleotide
ggaaacaggaaaucauuggaacatt

SEQ ID NO: 4874 - DNA, 25 bp, Artificial Sequence
  Synthetic oligonucleotide
gaaacaggaaaucauuggaacautt

SEQ ID NO: 4875 - DNA, 25 bp, Artificial Sequence
  Synthetic oligonucleotide
aaacaggaaaucauuggaacauutt

SEQ ID NO: 4876 - DNA, 25 bp, Artificial Sequence
  Synthetic oligonucleotide
aacaggaaaucauuggaacauuutt

SEQ ID NO: 4877 - DNA, 25 bp, Artificial Sequence
  Synthetic oligonucleotide
acaggaaaucauuggaacauuuutc

SEQ ID NO: 4878 - DNA, 25 bp, Artificial Sequence
  Synthetic oligonucleotide
caggaaaucauuggaacauuuuuca

SEQ ID NO: 4879 - DNA, 25 bp, Artificial Sequence
  Synthetic oligonucleotide
gaaaucauuggaacauuuuucautc

SEQ ID NO: 4880 - DNA, 25 bp, Artificial Sequence
  Synthetic oligonucleotide
aaaucauuggaacauuuuucauuct

SEQ ID NO: 4881 - DNA, 25 bp, Artificial Sequence
  Synthetic oligonucleotide
aaucauuggaacauuuuucauuctg

SEQ ID NO: 4882 - DNA, 25 bp, Artificial Sequence
  Synthetic oligonucleotide
aucauuggaacauuuuucauucuga

SEQ ID NO: 4883 - DNA, 25 bp, Artificial Sequence
  Synthetic oligonucleotide
ucauuggaacauuuuucauucugac

SEQ ID NO: 4884 - DNA, 25 bp, Artificial Sequence
  Synthetic oligonucleotide
cauuggaacauuuuucauucugacc

SEQ ID NO: 4885 - DNA, 25 bp, Artificial Sequence
  Synthetic oligonucleotide
auuggaacauuuuucauucugaccc

SEQ ID NO: 4886 - DNA, 25 bp, Artificial Sequence
  Synthetic oligonucleotide
gacccauuaauugaaaagcagaaac

SEQ ID NO: 4887 - DNA, 25 bp, Artificial Sequence
  Synthetic oligonucleotide
agaaaaaauuaaaagaagggaugtt

SEQ ID NO: 4888 - DNA, 25 bp, Artificial Sequence
  Synthetic oligonucleotide
gaaaaaauuaaaagaagggaugutg

SEQ ID NO: 4889 - DNA, 25 bp, Artificial Sequence
  Synthetic oligonucleotide
aaaaaauuaaaagaagggauguuga

SEQ ID NO: 4890 - DNA, 25 bp, Artificial Sequence
  Synthetic oligonucleotide
aaaaauuaaaagaagggauguugag

SEQ ID NO: 4891 - DNA, 25 bp, Artificial Sequence
  Synthetic oligonucleotide
aaaauuaaaagaagggauguugagc

SEQ ID NO: 4892 - DNA, 25 bp, Artificial Sequence
  Synthetic oligonucleotide
ugagcauuauguccuacagaaaugc

SEQ ID NO: 4893 - DNA, 25 bp, Artificial Sequence
  Synthetic oligonucleotide
agcauuauguccuacagaaaugctg

SEQ ID NO: 4894 - DNA, 25 bp, Artificial Sequence
  Synthetic oligonucleotide
gcauuauguccuacagaaaugcuga

SEQ ID NO: 4895 - DNA, 25 bp, Artificial Sequence
  Synthetic oligonucleotide
cauuauguccuacagaaaugcugac

SEQ ID NO: 4896 - DNA, 25 bp, Artificial Sequence
  Synthetic oligonucleotide
auuauguccuacagaaaugcugact

SEQ ID NO: 4897 - DNA, 25 bp, Artificial Sequence
  Synthetic oligonucleotide
uuauguccuacagaaaugcugacta

SEQ ID NO: 4898 - DNA, 25 bp, Artificial Sequence
  Synthetic oligonucleotide
uauguccuacagaaaugcugacuac

SEQ ID NO: 4899 - DNA, 25 bp, Artificial Sequence
  Synthetic oligonucleotide
auguccuacagaaaugcugacuact

SEQ ID NO: 4900 - DNA, 25 bp, Artificial Sequence
  Synthetic oligonucleotide
uguccuacagaaaugcugacuactc

SEQ ID NO: 4901 - DNA, 25 bp, Artificial Sequence
  Synthetic oligonucleotide
guccuacagaaaugcugacuacuct

SEQ ID NO: 4902 - DNA, 25 bp, Artificial Sequence
  Synthetic oligonucleotide
uccuacagaaaugcugacuacuctt

SEQ ID NO: 4903 - DNA, 25 bp, Artificial Sequence
  Synthetic oligonucleotide
ccuacagaaaugcugacuacucuta

SEQ ID NO: 4904 - DNA, 25 bp, Artificial Sequence
  Synthetic oligonucleotide
agugcuagcacuugguuaacagctt

SEQ ID NO: 4905 - DNA, 25 bp, Artificial Sequence
  Synthetic oligonucleotide
gugcuagcacuugguuaacagcutt

SEQ ID NO: 4906 - DNA, 25 bp, Artificial Sequence
  Synthetic oligonucleotide
ugcuagcacuugguuaacagcuutt

SEQ ID NO: 4907 - DNA, 25 bp, Artificial Sequence
  Synthetic oligonucleotide
gcuagcacuugguuaacagcuuutg

SEQ ID NO: 4908 - DNA, 25 bp, Artificial Sequence
  Synthetic oligonucleotide
cuagcacuugguuaacagcuuuugc

SEQ ID NO: 4909 - DNA, 25 bp, Artificial Sequence
  Synthetic oligonucleotide
uagcacuugguuaacagcuuuugct

SEQ ID NO: 4910 - DNA, 25 bp, Artificial Sequence
  Synthetic oligonucleotide
agcacuugguuaacagcuuuugctt

SEQ ID NO: 4911 - DNA, 25 bp, Artificial Sequence
  Synthetic oligonucleotide
gcacuugguuaacagcuuuugcutt

SEQ ID NO: 4912 - DNA, 25 bp, Artificial Sequence
  Synthetic oligonucleotide
cacuugguuaacagcuuuugcuuta

SEQ ID NO: 4913 - DNA, 25 bp, Artificial Sequence
  Synthetic oligonucleotide
acuugguuaacagcuuuugcuuuaa

SEQ ID NO: 4914 - DNA, 25 bp, Artificial Sequence
  Synthetic oligonucleotide
uugguuaacagcuuuugcuuuaaga

SEQ ID NO: 4915 - DNA, 25 bp, Artificial Sequence
  Synthetic oligonucleotide
ugguuaacagcuuuugcuuuaagag

SEQ ID NO: 4916 - DNA, 25 bp, Artificial Sequence
  Synthetic oligonucleotide
uuaacagcuuuugcuuuaagaguac

SEQ ID NO: 4917 - DNA, 25 bp, Artificial Sequence
  Synthetic oligonucleotide
uaacagcuuuugcuuuaagaguact

SEQ ID NO: 4918 - DNA, 25 bp, Artificial Sequence
  Synthetic oligonucleotide
aacagcuuuugcuuuaagaguactt

SEQ ID NO: 4919 - DNA, 25 bp, Artificial Sequence
  Synthetic oligonucleotide
acagcuuuugcuuuaagaguacutg

SEQ ID NO: 4920 - DNA, 25 bp, Artificial Sequence
  Synthetic oligonucleotide
cagcuuuugcuuuaagaguacuugg

SEQ ID NO: 4921 - DNA, 25 bp, Artificial Sequence
  Synthetic oligonucleotide
agcuuuugcuuuaagaguacuugga

SEQ ID NO: 4922 - DNA, 25 bp, Artificial Sequence
  Synthetic oligonucleotide
gcuuuugcuuuaagaguacuuggac

SEQ ID NO: 4923 - DNA, 25 bp, Artificial Sequence
  Synthetic oligonucleotide
cuuuugcuuuaagaguacuuggaca

SEQ ID NO: 4924 - DNA, 25 bp, Artificial Sequence
  Synthetic oligonucleotide
uuuugcuuuaagaguacuuggacaa

SEQ ID NO: 4925 - DNA, 25 bp, Artificial Sequence
  Synthetic oligonucleotide
uuugcuuuaagaguacuuggacaag

SEQ ID NO: 4926 - DNA, 25 bp, Artificial Sequence
  Synthetic oligonucleotide
uugcuuuaagaguacuuggacaagt

SEQ ID NO: 4927 - DNA, 25 bp, Artificial Sequence
  Synthetic oligonucleotide
ugcuuuaagaguacuuggacaagta

SEQ ID NO: 4928 - DNA, 25 bp, Artificial Sequence
  Synthetic oligonucleotide
uuuaagaguacuuggacaaguaaat

SEQ ID NO: 4929 - DNA, 25 bp, Artificial Sequence
  Synthetic oligonucleotide
uuaagaguacuuggacaaguaaata

SEQ ID NO: 4930 - DNA, 25 bp, Artificial Sequence
  Synthetic oligonucleotide
guagagcagaaccaaaauucaautt

SEQ ID NO: 4931 - DNA, 25 bp, Artificial Sequence
  Synthetic oligonucleotide
uguaauucuuuauuguggcuagutg

SEQ ID NO: 4932 - DNA, 25 bp, Artificial Sequence
  Synthetic oligonucleotide
guaauucuuuauuguggcuaguuga

SEQ ID NO: 4933 - DNA, 25 bp, Artificial Sequence
  Synthetic oligonucleotide
uucaaggaaaauucacaguaucaac

SEQ ID NO: 4934 - DNA, 25 bp, Artificial Sequence
  Synthetic oligonucleotide
ucaaggaaaauucacaguaucaacc

SEQ ID NO: 4935 - DNA, 25 bp, Artificial Sequence
  Synthetic oligonucleotide
caaggaaaauucacaguaucaacca

SEQ ID NO: 4936 - DNA, 25 bp, Artificial Sequence
  Synthetic oligonucleotide
aaggaaaauucacaguaucaaccaa

SEQ ID NO: 4937 - DNA, 25 bp, Artificial Sequence
  Synthetic oligonucleotide
aggaaaauucacaguaucaaccaat

SEQ ID NO: 4938 - DNA, 25 bp, Artificial Sequence
  Synthetic oligonucleotide
ggaaaauucacaguaucaaccaata

SEQ ID NO: 4939 - DNA, 25 bp, Artificial Sequence
  Synthetic oligonucleotide
gaaaauucacaguaucaaccaauaa

SEQ ID NO: 4940 - DNA, 25 bp, Artificial Sequence
  Synthetic oligonucleotide
aaaauucacaguaucaaccaauaaa

SEQ ID NO: 4941 - DNA, 25 bp, Artificial Sequence
  Synthetic oligonucleotide
aaauucacaguaucaaccaauaaaa

SEQ ID NO: 4942 - DNA, 25 bp, Artificial Sequence
  Synthetic oligonucleotide
aauucacaguaucaaccaauaaaat

SEQ ID NO: 4943 - DNA, 25 bp, Artificial Sequence
  Synthetic oligonucleotide
auucacaguaucaaccaauaaaatt

SEQ ID NO: 4944 - DNA, 25 bp, Artificial Sequence
  Synthetic oligonucleotide
uucacaguaucaaccaauaaaauta

SEQ ID NO: 4945 - DNA, 25 bp, Artificial Sequence
  Synthetic oligonucleotide
ucacaguaucaaccaauaaaauuac

SEQ ID NO: 4946 - DNA, 25 bp, Artificial Sequence
  Synthetic oligonucleotide
acaguaucaaccaauaaaauuacag

SEQ ID NO: 4947 - DNA, 25 bp, Artificial Sequence
  Synthetic oligonucleotide
caguaucaaccaauaaaauuacagg

SEQ ID NO: 4948 - DNA, 25 bp, Artificial Sequence
  Synthetic oligonucleotide
aguaucaaccaauaaaauuacaggg

SEQ ID NO: 4949 - DNA, 25 bp, Artificial Sequence
  Synthetic oligonucleotide
guaucaaccaauaaaauuacagggt

SEQ ID NO: 4950 - DNA, 25 bp, Artificial Sequence
  Synthetic oligonucleotide
uaucaaccaauaaaauuacagggta

SEQ ID NO: 4951 - DNA, 25 bp, Artificial Sequence
  Synthetic oligonucleotide
aucaaccaauaaaauuacaggguac

SEQ ID NO: 4952 - DNA, 25 bp, Artificial Sequence
  Synthetic oligonucleotide
ucaaccaauaaaauuacaggguacc

SEQ ID NO: 4953 - DNA, 25 bp, Artificial Sequence
  Synthetic oligonucleotide
cagcucuaauuaaagcugacaactt

SEQ ID NO: 4954 - DNA, 25 bp, Artificial Sequence
  Synthetic oligonucleotide
agcucuaauuaaagcugacaacutt

SEQ ID NO: 4955 - DNA, 25 bp, Artificial Sequence
  Synthetic oligonucleotide
gcucuaauuaaagcugacaacuutc

SEQ ID NO: 4956 - DNA, 25 bp, Artificial Sequence
  Synthetic oligonucleotide
cuuucugcuugaaaauacacugcca

SEQ ID NO: 4957 - DNA, 25 bp, Artificial Sequence
  Synthetic oligonucleotide
uuucugcuugaaaauacacugccag

SEQ ID NO: 4958 - DNA, 25 bp, Artificial Sequence
  Synthetic oligonucleotide
uucugcuugaaaauacacugccagc

SEQ ID NO: 4959 - DNA, 25 bp, Artificial Sequence
  Synthetic oligonucleotide
ucugcuugaaaauacacugccagcc

SEQ ID NO: 4960 - DNA, 25 bp, Artificial Sequence
  Synthetic oligonucleotide
cugcuugaaaauacacugccagccc

SEQ ID NO: 4961 - DNA, 25 bp, Artificial Sequence
  Synthetic oligonucleotide
ugcuugaaaauacacugccagccca

SEQ ID NO: 4962 - DNA, 25 bp, Artificial Sequence
  Synthetic oligonucleotide
gcuugaaaauacacugccagcccag

SEQ ID NO: 4963 - DNA, 25 bp, Artificial Sequence
  Synthetic oligonucleotide
cuugaaaauacacugccagcccaga

SEQ ID NO: 4964 - DNA, 25 bp, Artificial Sequence
  Synthetic oligonucleotide
uugaaaauacacugccagcccagag

SEQ ID NO: 4965 - DNA, 25 bp, Artificial Sequence
  Synthetic oligonucleotide
ugaaaauacacugccagcccagagc

SEQ ID NO: 4966 - DNA, 25 bp, Artificial Sequence
  Synthetic oligonucleotide
gaaaauacacugccagcccagagca

SEQ ID NO: 4967 - DNA, 25 bp, Artificial Sequence
  Synthetic oligonucleotide
aaaauacacugccagcccagagcac

SEQ ID NO: 4968 - DNA, 25 bp, Artificial Sequence
  Synthetic oligonucleotide
aaauacacugccagcccagagcacc

SEQ ID NO: 4969 - DNA, 25 bp, Artificial Sequence
  Synthetic oligonucleotide
aauacacugccagcccagagcacct

SEQ ID NO: 4970 - DNA, 25 bp, Artificial Sequence
  Synthetic oligonucleotide
auacacugccagcccagagcacctt

SEQ ID NO: 4971 - DNA, 25 bp, Artificial Sequence
  Synthetic oligonucleotide
uacacugccagcccagagcaccutt

SEQ ID NO: 4972 - DNA, 25 bp, Artificial Sequence
  Synthetic oligonucleotide
acacugccagcccagagcaccuuta

SEQ ID NO: 4973 - DNA, 25 bp, Artificial Sequence
  Synthetic oligonucleotide
cacugccagcccagagcaccuuuac

SEQ ID NO: 4974 - DNA, 25 bp, Artificial Sequence
  Synthetic oligonucleotide
acugccagcccagagcaccuuuaca

SEQ ID NO: 4975 - DNA, 25 bp, Artificial Sequence
  Synthetic oligonucleotide
cugccagcccagagcaccuuuacat

SEQ ID NO: 4976 - DNA, 25 bp, Artificial Sequence
  Synthetic oligonucleotide
ugccagcccagagcaccuuuacatt

SEQ ID NO: 4977 - DNA, 25 bp, Artificial Sequence
  Synthetic oligonucleotide
gccagcccagagcaccuuuacautg

SEQ ID NO: 4978 - DNA, 25 bp, Artificial Sequence
  Synthetic oligonucleotide
ccagcccagagcaccuuuacauugg

SEQ ID NO: 4979 - DNA, 25 bp, Artificial Sequence
  Synthetic oligonucleotide
cagcccagagcaccuuuacauuggc

SEQ ID NO: 4980 - DNA, 25 bp, Artificial Sequence
  Synthetic oligonucleotide
agcccagagcaccuuuacauuggcc

SEQ ID NO: 4981 - DNA, 25 bp, Artificial Sequence
  Synthetic oligonucleotide
gcccagagcaccuuuacauuggcca

SEQ ID NO: 4982 - DNA, 25 bp, Artificial Sequence
  Synthetic oligonucleotide
cccagagcaccuuuacauuggccat

SEQ ID NO: 4983 - DNA, 25 bp, Artificial Sequence
  Synthetic oligonucleotide
ccagagcaccuuuacauuggccatt

SEQ ID NO: 4984 - DNA, 25 bp, Artificial Sequence
  Synthetic oligonucleotide
cagagcaccuuuacauuggccautt

SEQ ID NO: 4985 - DNA, 25 bp, Artificial Sequence
  Synthetic oligonucleotide
agagcaccuuuacauuggccauutc

SEQ ID NO: 4986 - DNA, 25 bp, Artificial Sequence
  Synthetic oligonucleotide
gagcaccuuuacauuggccauuuct

SEQ ID NO: 4987 - DNA, 25 bp, Artificial Sequence
  Synthetic oligonucleotide
agcaccuuuacauuggccauuuctg

SEQ ID NO: 4988 - DNA, 25 bp, Artificial Sequence
  Synthetic oligonucleotide
gcaccuuuacauuggccauuucugc

SEQ ID NO: 4989 - DNA, 25 bp, Artificial Sequence
  Synthetic oligonucleotide
caccuuuacauuggccauuucugcg

SEQ ID NO: 4990 - DNA, 25 bp, Artificial Sequence
  Synthetic oligonucleotide
accuuuacauuggccauuucugcgt

SEQ ID NO: 4991 - DNA, 25 bp, Artificial Sequence
  Synthetic oligonucleotide
ccuuuacauuggccauuucugcgta

SEQ ID NO: 4992 - DNA, 25 bp, Artificial Sequence
  Synthetic oligonucleotide
cuuuacauuggccauuucugcguat

SEQ ID NO: 4993 - DNA, 25 bp, Artificial Sequence
  Synthetic oligonucleotide
uuuacauuggccauuucugcguatg

SEQ ID NO: 4994 - DNA, 25 bp, Artificial Sequence
  Synthetic oligonucleotide
uuacauuggccauuucugcguaugc

SEQ ID NO: 4995 - DNA, 25 bp, Artificial Sequence
  Synthetic oligonucleotide
uaugcucuuucccugggagauaaaa

SEQ ID NO: 4996 - DNA, 25 bp, Artificial Sequence
  Synthetic oligonucleotide
augcucuuucccugggagauaaaac

SEQ ID NO: 4997 - DNA, 25 bp, Artificial Sequence
  Synthetic oligonucleotide
ugcucuuucccugggagauaaaact

SEQ ID NO: 4998 - DNA, 25 bp, Artificial Sequence
  Synthetic oligonucleotide
gcucuuucccugggagauaaaactc

SEQ ID NO: 4999 - DNA, 25 bp, Artificial Sequence
  Synthetic oligonucleotide
cucuuucccugggagauaaaacuca

SEQ ID NO: 5000 - DNA, 25 bp, Artificial Sequence
  Synthetic oligonucleotide
ucuuucccugggagauaaaacucac

SEQ ID NO: 5001 - DNA, 25 bp, Artificial Sequence
  Synthetic oligonucleotide
cuuucccugggagauaaaacucacc

SEQ ID NO: 5002 - DNA, 25 bp, Artificial Sequence
  Synthetic oligonucleotide
uuucccugggagauaaaacucaccc

SEQ ID NO: 5003 - DNA, 25 bp, Artificial Sequence
  Synthetic oligonucleotide
uucccugggagauaaaacucaccca

SEQ ID NO: 5004 - DNA, 25 bp, Artificial Sequence
  Synthetic oligonucleotide
ucccugggagauaaaacucacccac

SEQ ID NO: 5005 - DNA, 25 bp, Artificial Sequence
  Synthetic oligonucleotide
cccugggagauaaaacucacccaca

SEQ ID NO: 5006 - DNA, 25 bp, Artificial Sequence
  Synthetic oligonucleotide
ccugggagauaaaacucacccacag

SEQ ID NO: 5007 - DNA, 25 bp, Artificial Sequence
  Synthetic oligonucleotide
cugggagauaaaacucacccacagt

SEQ ID NO: 5008 - DNA, 25 bp, Artificial Sequence
  Synthetic oligonucleotide
ugggagauaaaacucacccacagtt

SEQ ID NO: 5009 - DNA, 25 bp, Artificial Sequence
  Synthetic oligonucleotide
gggagauaaaacucacccacagutt

SEQ ID NO: 5010 - DNA, 25 bp, Artificial Sequence
  Synthetic oligonucleotide
ggagauaaaacucacccacaguutc

SEQ ID NO: 5011 - DNA, 25 bp, Artificial Sequence
  Synthetic oligonucleotide
gagauaaaacucacccacaguuucg

SEQ ID NO: 5012 - DNA, 25 bp, Artificial Sequence
  Synthetic oligonucleotide
agauaaaacucacccacaguuucgt

SEQ ID NO: 5013 - DNA, 25 bp, Artificial Sequence
  Synthetic oligonucleotide
gauaaaacucacccacaguuucgtt

SEQ ID NO: 5014 - DNA, 25 bp, Artificial Sequence
  Synthetic oligonucleotide
auaaaacucacccacaguuucgutc

SEQ ID NO: 5015 - DNA, 25 bp, Artificial Sequence
  Synthetic oligonucleotide
uaaaacucacccacaguuucguuca

SEQ ID NO: 5016 - DNA, 25 bp, Artificial Sequence
  Synthetic oligonucleotide
guucaauuguuucagcuuugaagag

SEQ ID NO: 5017 - DNA, 25 bp, Artificial Sequence
  Synthetic oligonucleotide
ucaauuguuucagcuuugaagagag

SEQ ID NO: 5018 - DNA, 25 bp, Artificial Sequence
  Synthetic oligonucleotide
caauuguuucagcuuugaagagaga

SEQ ID NO: 5019 - DNA, 25 bp, Artificial Sequence
  Synthetic oligonucleotide
aauuguuucagcuuugaagagagaa

SEQ ID NO: 5020 - DNA, 25 bp, Artificial Sequence
  Synthetic oligonucleotide
auuguuucagcuuugaagagagaag

SEQ ID NO: 5021 - DNA, 25 bp, Artificial Sequence
  Synthetic oligonucleotide
uuguuucagcuuugaagagagaagc

SEQ ID NO: 5022 - DNA, 25 bp, Artificial Sequence
  Synthetic oligonucleotide
uguuucagcuuugaagagagaagct

SEQ ID NO: 5023 - DNA, 25 bp, Artificial Sequence
  Synthetic oligonucleotide
guuucagcuuugaagagagaagctt

SEQ ID NO: 5024 - DNA, 25 bp, Artificial Sequence
  Synthetic oligonucleotide
uuucagcuuugaagagagaagcutt

SEQ ID NO: 5025 - DNA, 25 bp, Artificial Sequence
  Synthetic oligonucleotide
uucagcuuugaagagagaagcuutg

SEQ ID NO: 5026 - DNA, 25 bp, Artificial Sequence
  Synthetic oligonucleotide
ucagcuuugaagagagaagcuuugg

SEQ ID NO: 5027 - DNA, 25 bp, Artificial Sequence
  Synthetic oligonucleotide
cagcuuugaagagagaagcuuuggt

SEQ ID NO: 5028 - DNA, 25 bp, Artificial Sequence
  Synthetic oligonucleotide
agcuuugaagagagaagcuuuggtt

SEQ ID NO: 5029 - DNA, 25 bp, Artificial Sequence
  Synthetic oligonucleotide
gcuuugaagagagaagcuuugguta

SEQ ID NO: 5030 - DNA, 25 bp, Artificial Sequence
  Synthetic oligonucleotide
cuuugaagagagaagcuuugguuaa

SEQ ID NO: 5031 - DNA, 25 bp, Artificial Sequence
  Synthetic oligonucleotide
uuugaagagagaagcuuugguuaaa

SEQ ID NO: 5032 - DNA, 25 bp, Artificial Sequence
  Synthetic oligonucleotide
uugaagagagaagcuuugguuaaag

SEQ ID NO: 5033 - DNA, 25 bp, Artificial Sequence
  Synthetic oligonucleotide
ugaagagagaagcuuugguuaaagg

SEQ ID NO: 5034 - DNA, 25 bp, Artificial Sequence
  Synthetic oligonucleotide
gagagaagcuuugguuaaagguaat

SEQ ID NO: 5035 - DNA, 25 bp, Artificial Sequence
  Synthetic oligonucleotide
agagaagcuuugguuaaagguaatc

SEQ ID NO: 5036 - DNA, 25 bp, Artificial Sequence
  Synthetic oligonucleotide
gagaagcuuugguuaaagguaaucc

SEQ ID NO: 5037 - DNA, 25 bp, Artificial Sequence
  Synthetic oligonucleotide
aagcuuugguuaaagguaauccacc

SEQ ID NO: 5038 - DNA, 25 bp, Artificial Sequence
  Synthetic oligonucleotide
agcuuugguuaaagguaauccaccc

SEQ ID NO: 5039 - DNA, 25 bp, Artificial Sequence
  Synthetic oligonucleotide
gcuuugguuaaagguaauccaccca

SEQ ID NO: 5040 - DNA, 25 bp, Artificial Sequence
  Synthetic oligonucleotide
cuuugguuaaagguaauccacccat

SEQ ID NO: 5041 - DNA, 25 bp, Artificial Sequence
  Synthetic oligonucleotide
uuugguuaaagguaauccacccatt

SEQ ID NO: 5042 - DNA, 25 bp, Artificial Sequence
  Synthetic oligonucleotide
uugguuaaagguaauccacccautt

SEQ ID NO: 5043 - DNA, 25 bp, Artificial Sequence
  Synthetic oligonucleotide
ugguuaaagguaauccacccauuta

SEQ ID NO: 5044 - DNA, 25 bp, Artificial Sequence
  Synthetic oligonucleotide
gguuaaagguaauccacccauuuat

SEQ ID NO: 5045 - DNA, 25 bp, Artificial Sequence
  Synthetic oligonucleotide
guuaaagguaauccacccauuuatc

SEQ ID NO: 5046 - DNA, 25 bp, Artificial Sequence
  Synthetic oligonucleotide
uuaaagguaauccacccauuuaucg

SEQ ID NO: 5047 - DNA, 25 bp, Artificial Sequence
  Synthetic oligonucleotide
uaaagguaauccacccauuuaucgt

SEQ ID NO: 5048 - DNA, 25 bp, Artificial Sequence
  Synthetic oligonucleotide
aaagguaauccacccauuuaucgtt

SEQ ID NO: 5049 - DNA, 25 bp, Artificial Sequence
  Synthetic oligonucleotide
aagguaauccacccauuuaucgutt

SEQ ID NO: 5050 - DNA, 25 bp, Artificial Sequence
  Synthetic oligonucleotide
agguaauccacccauuuaucguutt

SEQ ID NO: 5051 - DNA, 25 bp, Artificial Sequence
  Synthetic oligonucleotide
gguaauccacccauuuaucguuutt

SEQ ID NO: 5052 - DNA, 25 bp, Artificial Sequence
  Synthetic oligonucleotide
guaauccacccauuuaucguuuutg

SEQ ID NO: 5053 - DNA, 25 bp, Artificial Sequence
  Synthetic oligonucleotide
uaauccacccauuuaucguuuuugg

SEQ ID NO: 5054 - DNA, 25 bp, Artificial Sequence
  Synthetic oligonucleotide
aauccacccauuuaucguuuuugga

SEQ ID NO: 5055 - DNA, 25 bp, Artificial Sequence
  Synthetic oligonucleotide
auccacccauuuaucguuuuuggaa

SEQ ID NO: 5056 - DNA, 25 bp, Artificial Sequence
  Synthetic oligonucleotide
uccacccauuuaucguuuuuggaaa

SEQ ID NO: 5057 - DNA, 25 bp, Artificial Sequence
  Synthetic oligonucleotide
ccacccauuuaucguuuuuggaaag

SEQ ID NO: 5058 - DNA, 25 bp, Artificial Sequence
  Synthetic oligonucleotide
cacccauuuaucguuuuuggaaaga

SEQ ID NO: 5059 - DNA, 25 bp, Artificial Sequence
  Synthetic oligonucleotide
acccauuuaucguuuuuggaaagac

SEQ ID NO: 5060 - DNA, 25 bp, Artificial Sequence
  Synthetic oligonucleotide
cccauuuaucguuuuuggaaagaca

SEQ ID NO: 5061 - DNA, 25 bp, Artificial Sequence
  Synthetic oligonucleotide
cauuuaucguuuuuggaaagacaat

SEQ ID NO: 5062 - DNA, 25 bp, Artificial Sequence
  Synthetic oligonucleotide
auuuaucguuuuuggaaagacaatc

SEQ ID NO: 5063 - DNA, 25 bp, Artificial Sequence
  Synthetic oligonucleotide
uuuaucguuuuuggaaagacaauct

SEQ ID NO: 5064 - DNA, 25 bp, Artificial Sequence
  Synthetic oligonucleotide
uuaucguuuuuggaaagacaauctt

SEQ ID NO: 5065 - DNA, 25 bp, Artificial Sequence
  Synthetic oligonucleotide
uaucguuuuuggaaagacaaucutc

SEQ ID NO: 5066 - DNA, 25 bp, Artificial Sequence
  Synthetic oligonucleotide
cauaaagacagcucuguaccuaaca

SEQ ID NO: 5067 - DNA, 25 bp, Artificial Sequence
  Synthetic oligonucleotide
auaaagacagcucuguaccuaacac

SEQ ID NO: 5068 - DNA, 25 bp, Artificial Sequence
  Synthetic oligonucleotide
uaaagacagcucuguaccuaacact

SEQ ID NO: 5069 - DNA, 25 bp, Artificial Sequence
  Synthetic oligonucleotide
aaagacagcucuguaccuaacactg

SEQ ID NO: 5070 - DNA, 25 bp, Artificial Sequence
  Synthetic oligonucleotide
aagacagcucuguaccuaacacugg

SEQ ID NO: 5071 - DNA, 25 bp, Artificial Sequence
  Synthetic oligonucleotide
agacagcucuguaccuaacacuggt

SEQ ID NO: 5072 - DNA, 25 bp, Artificial Sequence
  Synthetic oligonucleotide
gacagcucuguaccuaacacuggta

SEQ ID NO: 5073 - DNA, 25 bp, Artificial Sequence
  Synthetic oligonucleotide
acagcucuguaccuaacacugguac

SEQ ID NO: 5074 - DNA, 25 bp, Artificial Sequence
  Synthetic oligonucleotide
cagcucuguaccuaacacugguacg

SEQ ID NO: 5075 - DNA, 25 bp, Artificial Sequence
  Synthetic oligonucleotide
agcucuguaccuaacacugguacgg

SEQ ID NO: 5076 - DNA, 25 bp, Artificial Sequence
  Synthetic oligonucleotide
gcucuguaccuaacacugguacggc

SEQ ID NO: 5077 - DNA, 25 bp, Artificial Sequence
  Synthetic oligonucleotide
cucuguaccuaacacugguacggca

SEQ ID NO: 5078 - DNA, 25 bp, Artificial Sequence
  Synthetic oligonucleotide
ucuguaccuaacacugguacggcac

SEQ ID NO: 5079 - DNA, 25 bp, Artificial Sequence
  Synthetic oligonucleotide
cuguaccuaacacugguacggcacg

SEQ ID NO: 5080 - DNA, 25 bp, Artificial Sequence
  Synthetic oligonucleotide
gcacguaugguagaaacaacugcct

SEQ ID NO: 5081 - DNA, 25 bp, Artificial Sequence
  Synthetic oligonucleotide
cacguaugguagaaacaacugccta

SEQ ID NO: 5082 - DNA, 25 bp, Artificial Sequence
  Synthetic oligonucleotide
acguaugguagaaacaacugccuat

SEQ ID NO: 5083 - DNA, 25 bp, Artificial Sequence
  Synthetic oligonucleotide
cguaugguagaaacaacugccuatg

SEQ ID NO: 5084 - DNA, 25 bp, Artificial Sequence
  Synthetic oligonucleotide
guaugguagaaacaacugccuaugc

SEQ ID NO: 5085 - DNA, 25 bp, Artificial Sequence
  Synthetic oligonucleotide
uaugguagaaacaacugccuaugct

SEQ ID NO: 5086 - DNA, 25 bp, Artificial Sequence
  Synthetic oligonucleotide
augguagaaacaacugccuaugctt

SEQ ID NO: 5087 - DNA, 25 bp, Artificial Sequence
  Synthetic oligonucleotide
ugguagaaacaacugccuaugcutt

SEQ ID NO: 5088 - DNA, 25 bp, Artificial Sequence
  Synthetic oligonucleotide
gguagaaacaacugccuaugcuuta

SEQ ID NO: 5089 - DNA, 25 bp, Artificial Sequence
  Synthetic oligonucleotide
guagaaacaacugccuaugcuuuac

SEQ ID NO: 5090 - DNA, 25 bp, Artificial Sequence
  Synthetic oligonucleotide
uagaaacaacugccuaugcuuuact

SEQ ID NO: 5091 - DNA, 25 bp, Artificial Sequence
  Synthetic oligonucleotide
agaaacaacugccuaugcuuuactc

SEQ ID NO: 5092 - DNA, 25 bp, Artificial Sequence
  Synthetic oligonucleotide
gaaacaacugccuaugcuuuacuca

SEQ ID NO: 5093 - DNA, 25 bp, Artificial Sequence
  Synthetic oligonucleotide
aaacaacugccuaugcuuuacucac

SEQ ID NO: 5094 - DNA, 25 bp, Artificial Sequence
  Synthetic oligonucleotide
aacaacugccuaugcuuuacucacc

SEQ ID NO: 5095 - DNA, 25 bp, Artificial Sequence
  Synthetic oligonucleotide
acaacugccuaugcuuuacucacca

SEQ ID NO: 5096 - DNA, 25 bp, Artificial Sequence
  Synthetic oligonucleotide
caacugccuaugcuuuacucaccag

SEQ ID NO: 5097 - DNA, 25 bp, Artificial Sequence
  Synthetic oligonucleotide
aacugccuaugcuuuacucaccagt

SEQ ID NO: 5098 - DNA, 25 bp, Artificial Sequence
  Synthetic oligonucleotide
acugccuaugcuuuacucaccagtc

SEQ ID NO: 5099 - DNA, 25 bp, Artificial Sequence
  Synthetic oligonucleotide
cugccuaugcuuuacucaccaguct

SEQ ID NO: 5100 - DNA, 25 bp, Artificial Sequence
  Synthetic oligonucleotide
ugccuaugcuuuacucaccaguctg

SEQ ID NO: 5101 - DNA, 25 bp, Artificial Sequence
  Synthetic oligonucleotide
gccuaugcuuuacucaccagucuga

SEQ ID NO: 5102 - DNA, 25 bp, Artificial Sequence
  Synthetic oligonucleotide
ccuaugcuuuacucaccagucugaa

SEQ ID NO: 5103 - DNA, 25 bp, Artificial Sequence
  Synthetic oligonucleotide
cuaugcuuuacucaccagucugaac

SEQ ID NO: 5104 - DNA, 25 bp, Artificial Sequence
  Synthetic oligonucleotide
uaugcuuuacucaccagucugaact

SEQ ID NO: 5105 - DNA, 25 bp, Artificial Sequence
  Synthetic oligonucleotide
augcuuuacucaccagucugaactt

SEQ ID NO: 5106 - DNA, 25 bp, Artificial Sequence
  Synthetic oligonucleotide
ugcuuuacucaccagucugaacutg

SEQ ID NO: 5107 - DNA, 25 bp, Artificial Sequence
  Synthetic oligonucleotide
uuuacucaccagucugaacuugaaa

SEQ ID NO: 5108 - DNA, 25 bp, Artificial Sequence
  Synthetic oligonucleotide
uuacucaccagucugaacuugaaag

SEQ ID NO: 5109 - DNA, 25 bp, Artificial Sequence
  Synthetic oligonucleotide
uacucaccagucugaacuugaaaga

SEQ ID NO: 5110 - DNA, 25 bp, Artificial Sequence
  Synthetic oligonucleotide
acucaccagucugaacuugaaagat

SEQ ID NO: 5111 - DNA, 25 bp, Artificial Sequence
  Synthetic oligonucleotide
ucaccagucugaacuugaaagauat

SEQ ID NO: 5112 - DNA, 25 bp, Artificial Sequence
  Synthetic oligonucleotide
caccagucugaacuugaaagauata

SEQ ID NO: 5113 - DNA, 25 bp, Artificial Sequence
  Synthetic oligonucleotide
accagucugaacuugaaagauauaa

SEQ ID NO: 5114 - DNA, 25 bp, Artificial Sequence
  Synthetic oligonucleotide
ucaucaaauggcuaucagaagagca

SEQ ID NO: 5115 - DNA, 25 bp, Artificial Sequence
  Synthetic oligonucleotide
caucaaauggcuaucagaagagcag

SEQ ID NO: 5116 - DNA, 25 bp, Artificial Sequence
  Synthetic oligonucleotide
aucaaauggcuaucagaagagcaga

SEQ ID NO: 5117 - DNA, 25 bp, Artificial Sequence
  Synthetic oligonucleotide
ucaaauggcuaucagaagagcagag

SEQ ID NO: 5118 - DNA, 25 bp, Artificial Sequence
  Synthetic oligonucleotide
caaauggcuaucagaagagcagagg

SEQ ID NO: 5119 - DNA, 25 bp, Artificial Sequence
  Synthetic oligonucleotide
aaauggcuaucagaagagcagaggt

SEQ ID NO: 5120 - DNA, 25 bp, Artificial Sequence
  Synthetic oligonucleotide
aauggcuaucagaagagcagaggta

SEQ ID NO: 5121 - DNA, 25 bp, Artificial Sequence
  Synthetic oligonucleotide
auggcuaucagaagagcagagguat

SEQ ID NO: 5122 - DNA, 25 bp, Artificial Sequence
  Synthetic oligonucleotide
uggcuaucagaagagcagagguatg

SEQ ID NO: 5123 - DNA, 25 bp, Artificial Sequence
  Synthetic oligonucleotide
ggcuaucagaagagcagagguaugg

SEQ ID NO: 5124 - DNA, 25 bp, Artificial Sequence
  Synthetic oligonucleotide
gcuaucagaagagcagagguaugga

SEQ ID NO: 5125 - DNA, 25 bp, Artificial Sequence
  Synthetic oligonucleotide
cuaucagaagagcagagguauggag

SEQ ID NO: 5126 - DNA, 25 bp, Artificial Sequence
  Synthetic oligonucleotide
uaucagaagagcagagguauggagg

SEQ ID NO: 5127 - DNA, 25 bp, Artificial Sequence
  Synthetic oligonucleotide
aucagaagagcagagguauggaggt

SEQ ID NO: 5128 - DNA, 25 bp, Artificial Sequence
  Synthetic oligonucleotide
ucagaagagcagagguauggaggtg

SEQ ID NO: 5129 - DNA, 25 bp, Artificial Sequence
  Synthetic oligonucleotide
cagaagagcagagguauggaggugg

SEQ ID NO: 5130 - DNA, 25 bp, Artificial Sequence
  Synthetic oligonucleotide
agaagagcagagguauggagguggc

SEQ ID NO: 5131 - DNA, 25 bp, Artificial Sequence
  Synthetic oligonucleotide
agagcagagguauggagguggcutt

SEQ ID NO: 5132 - DNA, 25 bp, Artificial Sequence
  Synthetic oligonucleotide
gagcagagguauggagguggcuutt

SEQ ID NO: 5133 - DNA, 25 bp, Artificial Sequence
  Synthetic oligonucleotide
agcagagguauggagguggcuuuta

SEQ ID NO: 5134 - DNA, 25 bp, Artificial Sequence
  Synthetic oligonucleotide
gcagagguauggagguggcuuuuat

SEQ ID NO: 5135 - DNA, 25 bp, Artificial Sequence
  Synthetic oligonucleotide
cagagguauggagguggcuuuuatt

SEQ ID NO: 5136 - DNA, 25 bp, Artificial Sequence
  Synthetic oligonucleotide
agagguauggagguggcuuuuautc

SEQ ID NO: 5137 - DNA, 25 bp, Artificial Sequence
  Synthetic oligonucleotide
gagguauggagguggcuuuuauuca

SEQ ID NO: 5138 - DNA, 25 bp, Artificial Sequence
  Synthetic oligonucleotide
agguauggagguggcuuuuauucaa

SEQ ID NO: 5139 - DNA, 25 bp, Artificial Sequence
  Synthetic oligonucleotide
gguauggagguggcuuuuauucaac

SEQ ID NO: 5140 - DNA, 25 bp, Artificial Sequence
  Synthetic oligonucleotide
guauggagguggcuuuuauucaacc

SEQ ID NO: 5141 - DNA, 25 bp, Artificial Sequence
  Synthetic oligonucleotide
uauggagguggcuuuuauucaaccc

SEQ ID NO: 5142 - DNA, 25 bp, Artificial Sequence
  Synthetic oligonucleotide
auggagguggcuuuuauucaaccca

SEQ ID NO: 5143 - DNA, 25 bp, Artificial Sequence
  Synthetic oligonucleotide
uggagguggcuuuuauucaacccag

SEQ ID NO: 5144 - DNA, 25 bp, Artificial Sequence
  Synthetic oligonucleotide
ggagguggcuuuuauucaacccagg

SEQ ID NO: 5145 - DNA, 25 bp, Artificial Sequence
  Synthetic oligonucleotide
gagguggcuuuuauucaacccagga

SEQ ID NO: 5146 - DNA, 25 bp, Artificial Sequence
  Synthetic oligonucleotide
agguggcuuuuauucaacccaggac

SEQ ID NO: 5147 - DNA, 25 bp, Artificial Sequence
  Synthetic oligonucleotide
gguggcuuuuauucaacccaggaca

SEQ ID NO: 5148 - DNA, 25 bp, Artificial Sequence
  Synthetic oligonucleotide
guggcuuuuauucaacccaggacac

SEQ ID NO: 5149 - DNA, 25 bp, Artificial Sequence
  Synthetic oligonucleotide
aauauucacuccugguuaaacaact

SEQ ID NO: 5150 - DNA, 25 bp, Artificial Sequence
  Synthetic oligonucleotide
auauucacuccugguuaaacaactc

SEQ ID NO: 5151 - DNA, 25 bp, Artificial Sequence
  Synthetic oligonucleotide
uauucacuccugguuaaacaacucc

SEQ ID NO: 5152 - DNA, 25 bp, Artificial Sequence
  Synthetic oligonucleotide
auucacuccugguuaaacaacuccg

SEQ ID NO: 5153 - DNA, 25 bp, Artificial Sequence
  Synthetic oligonucleotide
cuuacauaauuauaaaaugacagac

SEQ ID NO: 5154 - DNA, 25 bp, Artificial Sequence
  Synthetic oligonucleotide
uuacauaauuauaaaaugacagaca

SEQ ID NO: 5155 - DNA, 25 bp, Artificial Sequence
  Synthetic oligonucleotide
uacauaauuauaaaaugacagacaa

SEQ ID NO: 5156 - DNA, 25 bp, Artificial Sequence
  Synthetic oligonucleotide
acauaauuauaaaaugacagacaag

SEQ ID NO: 5157 - DNA, 25 bp, Artificial Sequence
  Synthetic oligonucleotide
cauaauuauaaaaugacagacaaga

SEQ ID NO: 5158 - DNA, 25 bp, Artificial Sequence
  Synthetic oligonucleotide
auaauuauaaaaugacagacaagaa

SEQ ID NO: 5159 - DNA, 25 bp, Artificial Sequence
  Synthetic oligonucleotide
uaauuauaaaaugacagacaagaat

SEQ ID NO: 5160 - DNA, 25 bp, Artificial Sequence
  Synthetic oligonucleotide
aauuauaaaaugacagacaagaatt

SEQ ID NO: 5161 - DNA, 25 bp, Artificial Sequence
  Synthetic oligonucleotide
auuauaaaaugacagacaagaautt

SEQ ID NO: 5162 - DNA, 25 bp, Artificial Sequence
  Synthetic oligonucleotide
uuauaaaaugacagacaagaauutc

SEQ ID NO: 5163 - DNA, 25 bp, Artificial Sequence
  Synthetic oligonucleotide
uauaaaaugacagacaagaauuucc

SEQ ID NO: 5164 - DNA, 25 bp, Artificial Sequence
  Synthetic oligonucleotide
auaaaaugacagacaagaauuucct

SEQ ID NO: 5165 - DNA, 25 bp, Artificial Sequence
  Synthetic oligonucleotide
uaaaaugacagacaagaauuucctt

SEQ ID NO: 5166 - DNA, 25 bp, Artificial Sequence
  Synthetic oligonucleotide
aaaaugacagacaagaauuuccutg

SEQ ID NO: 5167 - DNA, 25 bp, Artificial Sequence
  Synthetic oligonucleotide
aaaugacagacaagaauuuccuugg

SEQ ID NO: 5168 - DNA, 25 bp, Artificial Sequence
  Synthetic oligonucleotide
aaugacagacaagaauuuccuuggg

SEQ ID NO: 5169 - DNA, 25 bp, Artificial Sequence
  Synthetic oligonucleotide
augacagacaagaauuuccuuggga

SEQ ID NO: 5170 - DNA, 25 bp, Artificial Sequence
  Synthetic oligonucleotide
ugacagacaagaauuuccuugggag

SEQ ID NO: 5171 - DNA, 25 bp, Artificial Sequence
  Synthetic oligonucleotide
gacagacaagaauuuccuugggagg

SEQ ID NO: 5172 - DNA, 25 bp, Artificial Sequence
  Synthetic oligonucleotide
acagacaagaauuuccuugggaggc

SEQ ID NO: 5173 - DNA, 25 bp, Artificial Sequence
  Synthetic oligonucleotide
cagacaagaauuuccuugggaggcc

SEQ ID NO: 5174 - DNA, 25 bp, Artificial Sequence
  Synthetic oligonucleotide
agacaagaauuuccuugggaggcca

SEQ ID NO: 5175 - DNA, 25 bp, Artificial Sequence
  Synthetic oligonucleotide
gacaagaauuuccuugggaggccag

SEQ ID NO: 5176 - DNA, 25 bp, Artificial Sequence
  Synthetic oligonucleotide
acaagaauuuccuugggaggccagt

SEQ ID NO: 5177 - DNA, 25 bp, Artificial Sequence
  Synthetic oligonucleotide
caagaauuuccuugggaggccagta

SEQ ID NO: 5178 - DNA, 25 bp, Artificial Sequence
  Synthetic oligonucleotide
aagaauuuccuugggaggccaguag

SEQ ID NO: 5179 - DNA, 25 bp, Artificial Sequence
  Synthetic oligonucleotide
agaauuuccuugggaggccaguaga

SEQ ID NO: 5180 - DNA, 25 bp, Artificial Sequence
  Synthetic oligonucleotide
gaauuuccuugggaggccaguagag

SEQ ID NO: 5181 - DNA, 25 bp, Artificial Sequence
  Synthetic oligonucleotide
cuugggaggccaguagaggugcutc

SEQ ID NO: 5182 - DNA, 25 bp, Artificial Sequence
  Synthetic oligonucleotide
gggaggccaguagaggugcuucuca

SEQ ID NO: 5183 - DNA, 25 bp, Artificial Sequence
  Synthetic oligonucleotide
ggaggccaguagaggugcuucucaa

SEQ ID NO: 5184 - DNA, 25 bp, Artificial Sequence
  Synthetic oligonucleotide
gaggccaguagaggugcuucucaat

SEQ ID NO: 5185 - DNA, 25 bp, Artificial Sequence
  Synthetic oligonucleotide
aggccaguagaggugcuucucaatg

SEQ ID NO: 5186 - DNA, 25 bp, Artificial Sequence
  Synthetic oligonucleotide
ggccaguagaggugcuucucaauga

SEQ ID NO: 5187 - DNA, 25 bp, Artificial Sequence
  Synthetic oligonucleotide
gccaguagaggugcuucucaaugat

SEQ ID NO: 5188 - DNA, 25 bp, Artificial Sequence
  Synthetic oligonucleotide
ccaguagaggugcuucucaaugatg

SEQ ID NO: 5189 - DNA, 25 bp, Artificial Sequence
  Synthetic oligonucleotide
caguagaggugcuucucaaugauga

SEQ ID NO: 5190 - DNA, 25 bp, Artificial Sequence
  Synthetic oligonucleotide
aguagaggugcuucucaaugaugac

SEQ ID NO: 5191 - DNA, 25 bp, Artificial Sequence
  Synthetic oligonucleotide
guagaggugcuucucaaugaugacc

SEQ ID NO: 5192 - DNA, 25 bp, Artificial Sequence
  Synthetic oligonucleotide
uagaggugcuucucaaugaugacct

SEQ ID NO: 5193 - DNA, 25 bp, Artificial Sequence
  Synthetic oligonucleotide
agaggugcuucucaaugaugacctc

SEQ ID NO: 5194 - DNA, 25 bp, Artificial Sequence
  Synthetic oligonucleotide
gaggugcuucucaaugaugaccuca

SEQ ID NO: 5195 - DNA, 25 bp, Artificial Sequence
  Synthetic oligonucleotide
aggugcuucucaaugaugaccucat

SEQ ID NO: 5196 - DNA, 25 bp, Artificial Sequence
  Synthetic oligonucleotide
ggugcuucucaaugaugaccucatt

SEQ ID NO: 5197 - DNA, 25 bp, Artificial Sequence
  Synthetic oligonucleotide
gugcuucucaaugaugaccucautg

SEQ ID NO: 5198 - DNA, 25 bp, Artificial Sequence
  Synthetic oligonucleotide
ugcuucucaaugaugaccucauugt

SEQ ID NO: 5199 - DNA, 25 bp, Artificial Sequence
  Synthetic oligonucleotide
gcuucucaaugaugaccucauugtc

SEQ ID NO: 5200 - DNA, 25 bp, Artificial Sequence
  Synthetic oligonucleotide
uugucaguacaggauuuggcagugg

SEQ ID NO: 5201 - DNA, 25 bp, Artificial Sequence
  Synthetic oligonucleotide
ugucaguacaggauuuggcaguggc

SEQ ID NO: 5202 - DNA, 25 bp, Artificial Sequence
  Synthetic oligonucleotide
gucaguacaggauuuggcaguggct

SEQ ID NO: 5203 - DNA, 25 bp, Artificial Sequence
  Synthetic oligonucleotide
ucaguacaggauuuggcaguggctt

SEQ ID NO: 5204 - DNA, 25 bp, Artificial Sequence
  Synthetic oligonucleotide
caguacaggauuuggcaguggcutg

SEQ ID NO: 5205 - DNA, 25 bp, Artificial Sequence
  Synthetic oligonucleotide
aguacaggauuuggcaguggcuugg

SEQ ID NO: 5206 - DNA, 25 bp, Artificial Sequence
  Synthetic oligonucleotide
guacaggauuuggcaguggcuuggc

SEQ ID NO: 5207 - DNA, 25 bp, Artificial Sequence
  Synthetic oligonucleotide
uacaggauuuggcaguggcuuggct

SEQ ID NO: 5208 - DNA, 25 bp, Artificial Sequence
  Synthetic oligonucleotide
acaggauuuggcaguggcuuggcta

SEQ ID NO: 5209 - DNA, 25 bp, Artificial Sequence
  Synthetic oligonucleotide
caggauuuggcaguggcuuggcuac

SEQ ID NO: 5210 - DNA, 25 bp, Artificial Sequence
  Synthetic oligonucleotide
aggauuuggcaguggcuuggcuaca

SEQ ID NO: 5211 - DNA, 25 bp, Artificial Sequence
  Synthetic oligonucleotide
gauuuggcaguggcuuggcuacagt

SEQ ID NO: 5212 - DNA, 25 bp, Artificial Sequence
  Synthetic oligonucleotide
auuuggcaguggcuuggcuacagta

SEQ ID NO: 5213 - DNA, 25 bp, Artificial Sequence
  Synthetic oligonucleotide
uuuggcaguggcuuggcuacaguac

SEQ ID NO: 5214 - DNA, 25 bp, Artificial Sequence
  Synthetic oligonucleotide
uuggcaguggcuuggcuacaguaca

SEQ ID NO: 5215 - DNA, 25 bp, Artificial Sequence
  Synthetic oligonucleotide
guacauguaacaacuguaguucaca

SEQ ID NO: 5216 - DNA, 25 bp, Artificial Sequence
  Synthetic oligonucleotide
uacauguaacaacuguaguucacaa

SEQ ID NO: 5217 - DNA, 25 bp, Artificial Sequence
  Synthetic oligonucleotide
acauguaacaacuguaguucacaaa

SEQ ID NO: 5218 - DNA, 25 bp, Artificial Sequence
  Synthetic oligonucleotide
auguaacaacuguaguucacaaaac

SEQ ID NO: 5219 - DNA, 25 bp, Artificial Sequence
  Synthetic oligonucleotide
uguaacaacuguaguucacaaaacc

SEQ ID NO: 5220 - DNA, 25 bp, Artificial Sequence
  Synthetic oligonucleotide
guaacaacuguaguucacaaaacca

SEQ ID NO: 5221 - DNA, 25 bp, Artificial Sequence
  Synthetic oligonucleotide
uaacaacuguaguucacaaaaccag

SEQ ID NO: 5222 - DNA, 25 bp, Artificial Sequence
  Synthetic oligonucleotide
aacaacuguaguucacaaaaccagt

SEQ ID NO: 5223 - DNA, 25 bp, Artificial Sequence
  Synthetic oligonucleotide
acaacuguaguucacaaaaccagta

SEQ ID NO: 5224 - DNA, 25 bp, Artificial Sequence
  Synthetic oligonucleotide
caacuguaguucacaaaaccaguac

SEQ ID NO: 5225 - DNA, 25 bp, Artificial Sequence
  Synthetic oligonucleotide
aacuguaguucacaaaaccaguacc

SEQ ID NO: 5226 - DNA, 25 bp, Artificial Sequence
  Synthetic oligonucleotide
acuguaguucacaaaaccaguacct

SEQ ID NO: 5227 - DNA, 25 bp, Artificial Sequence
  Synthetic oligonucleotide
cuguaguucacaaaaccaguacctc

SEQ ID NO: 5228 - DNA, 25 bp, Artificial Sequence
  Synthetic oligonucleotide
uguaguucacaaaaccaguaccuct

SEQ ID NO: 5229 - DNA, 25 bp, Artificial Sequence
  Synthetic oligonucleotide
guaguucacaaaaccaguaccuctg

SEQ ID NO: 5230 - DNA, 25 bp, Artificial Sequence
  Synthetic oligonucleotide
uaguucacaaaaccaguaccucuga

SEQ ID NO: 5231 - DNA, 25 bp, Artificial Sequence
  Synthetic oligonucleotide
aguucacaaaaccaguaccucugag

SEQ ID NO: 5232 - DNA, 25 bp, Artificial Sequence
  Synthetic oligonucleotide
guucacaaaaccaguaccucugagg

SEQ ID NO: 5233 - DNA, 25 bp, Artificial Sequence
  Synthetic oligonucleotide
uucacaaaaccaguaccucugagga

SEQ ID NO: 5234 - DNA, 25 bp, Artificial Sequence
  Synthetic oligonucleotide
ucacaaaaccaguaccucugaggaa

SEQ ID NO: 5235 - DNA, 25 bp, Artificial Sequence
  Synthetic oligonucleotide
cacaaaaccaguaccucugaggaag

SEQ ID NO: 5236 - DNA, 25 bp, Artificial Sequence
  Synthetic oligonucleotide
acaaaaccaguaccucugaggaagt

SEQ ID NO: 5237 - DNA, 25 bp, Artificial Sequence
  Synthetic oligonucleotide
caaaaccaguaccucugaggaagtt

SEQ ID NO: 5238 - DNA, 25 bp, Artificial Sequence
  Synthetic oligonucleotide
aaaaccaguaccucugaggaagutt

SEQ ID NO: 5239 - DNA, 25 bp, Artificial Sequence
  Synthetic oligonucleotide
aaaccaguaccucugaggaaguutg

SEQ ID NO: 5240 - DNA, 25 bp, Artificial Sequence
  Synthetic oligonucleotide
aaccaguaccucugaggaaguuugc

SEQ ID NO: 5241 - DNA, 25 bp, Artificial Sequence
  Synthetic oligonucleotide
accaguaccucugaggaaguuugca

SEQ ID NO: 5242 - DNA, 25 bp, Artificial Sequence
  Synthetic oligonucleotide
ccaguaccucugaggaaguuugcag

SEQ ID NO: 5243 - DNA, 25 bp, Artificial Sequence
  Synthetic oligonucleotide
caguaccucugaggaaguuugcagc

SEQ ID NO: 5244 - DNA, 25 bp, Artificial Sequence
  Synthetic oligonucleotide
aguaccucugaggaaguuugcagct

SEQ ID NO: 5245 - DNA, 25 bp, Artificial Sequence
  Synthetic oligonucleotide
guaccucugaggaaguuugcagctt

SEQ ID NO: 5246 - DNA, 25 bp, Artificial Sequence
  Synthetic oligonucleotide
uaccucugaggaaguuugcagcutt

SEQ ID NO: 5247 - DNA, 25 bp, Artificial Sequence
  Synthetic oligonucleotide
accucugaggaaguuugcagcuutt

SEQ ID NO: 5248 - DNA, 25 bp, Artificial Sequence
  Synthetic oligonucleotide
ccucugaggaaguuugcagcuuuta

SEQ ID NO: 5249 - DNA, 25 bp, Artificial Sequence
  Synthetic oligonucleotide
cucugaggaaguuugcagcuuuuat

SEQ ID NO: 5250 - DNA, 25 bp, Artificial Sequence
  Synthetic oligonucleotide
ucugaggaaguuugcagcuuuuatt

SEQ ID NO: 5251 - DNA, 25 bp, Artificial Sequence
  Synthetic oligonucleotide
cugaggaaguuugcagcuuuuautt

SEQ ID NO: 5252 - DNA, 25 bp, Artificial Sequence
  Synthetic oligonucleotide
ugaggaaguuugcagcuuuuauutg

SEQ ID NO: 5253 - DNA, 25 bp, Artificial Sequence
  Synthetic oligonucleotide
uugcagcuuuuauuugaaaaucgat

SEQ ID NO: 5254 - DNA, 25 bp, Artificial Sequence
  Synthetic oligonucleotide
ugcagcuuuuauuugaaaaucgata

SEQ ID NO: 5255 - DNA, 25 bp, Artificial Sequence
  Synthetic oligonucleotide
gauacucaggauauugaagcauccc

SEQ ID NO: 5256 - DNA, 25 bp, Artificial Sequence
  Synthetic oligonucleotide
uacucaggauauugaagcaucccac

SEQ ID NO: 5257 - DNA, 25 bp, Artificial Sequence
  Synthetic oligonucleotide
acucaggauauugaagcaucccact

SEQ ID NO: 5258 - DNA, 25 bp, Artificial Sequence
  Synthetic oligonucleotide
cucaggauauugaagcaucccacta

SEQ ID NO: 5259 - DNA, 25 bp, Artificial Sequence
  Synthetic oligonucleotide
ucaggauauugaagcaucccacuac

SEQ ID NO: 5260 - DNA, 25 bp, Artificial Sequence
  Synthetic oligonucleotide
aggauauugaagcaucccacuacag

SEQ ID NO: 5261 - DNA, 25 bp, Artificial Sequence
  Synthetic oligonucleotide
ggauauugaagcaucccacuacaga

SEQ ID NO: 5262 - DNA, 25 bp, Artificial Sequence
  Synthetic oligonucleotide
gauauugaagcaucccacuacagag

SEQ ID NO: 5263 - DNA, 25 bp, Artificial Sequence
  Synthetic oligonucleotide
auauugaagcaucccacuacagagg

SEQ ID NO: 5264 - DNA, 25 bp, Artificial Sequence
  Synthetic oligonucleotide
uauugaagcaucccacuacagaggc

SEQ ID NO: 5265 - DNA, 25 bp, Artificial Sequence
  Synthetic oligonucleotide
auugaagcaucccacuacagaggct

SEQ ID NO: 5266 - DNA, 25 bp, Artificial Sequence
  Synthetic oligonucleotide
uugaagcaucccacuacagaggcta

SEQ ID NO: 5267 - DNA, 25 bp, Artificial Sequence
  Synthetic oligonucleotide
ugaagcaucccacuacagaggcuac

SEQ ID NO: 5268 - DNA, 25 bp, Artificial Sequence
  Synthetic oligonucleotide
gaagcaucccacuacagaggcuacg

SEQ ID NO: 5269 - DNA, 25 bp, Artificial Sequence
  Synthetic oligonucleotide
aagcaucccacuacagaggcuacgg

SEQ ID NO: 5270 - DNA, 25 bp, Artificial Sequence
  Synthetic oligonucleotide
agcaucccacuacagaggcuacgga

SEQ ID NO: 5271 - DNA, 25 bp, Artificial Sequence
  Synthetic oligonucleotide
gcaucccacuacagaggcuacggaa

SEQ ID NO: 5272 - DNA, 25 bp, Artificial Sequence
  Synthetic oligonucleotide
caucccacuacagaggcuacggaaa

SEQ ID NO: 5273 - DNA, 25 bp, Artificial Sequence
  Synthetic oligonucleotide
aucccacuacagaggcuacggaaac

SEQ ID NO: 5274 - DNA, 25 bp, Artificial Sequence
  Synthetic oligonucleotide
ucccacuacagaggcuacggaaact

SEQ ID NO: 5275 - DNA, 25 bp, Artificial Sequence
  Synthetic oligonucleotide
cccacuacagaggcuacggaaactc

SEQ ID NO: 5276 - DNA, 25 bp, Artificial Sequence
  Synthetic oligonucleotide
ccacuacagaggcuacggaaacuct

SEQ ID NO: 5277 - DNA, 25 bp, Artificial Sequence
  Synthetic oligonucleotide
cacuacagaggcuacggaaacuctg

SEQ ID NO: 5278 - DNA, 25 bp, Artificial Sequence
  Synthetic oligonucleotide
acuacagaggcuacggaaacucuga

SEQ ID NO: 5279 - DNA, 25 bp, Artificial Sequence
  Synthetic oligonucleotide
cuacagaggcuacggaaacucugat

SEQ ID NO: 5280 - DNA, 25 bp, Artificial Sequence
  Synthetic oligonucleotide
uacagaggcuacggaaacucugatt

SEQ ID NO: 5281 - DNA, 25 bp, Artificial Sequence
  Synthetic oligonucleotide
acagaggcuacggaaacucugauta

SEQ ID NO: 5282 - DNA, 25 bp, Artificial Sequence
  Synthetic oligonucleotide
cagaggcuacggaaacucugauuac

SEQ ID NO: 5283 - DNA, 25 bp, Artificial Sequence
  Synthetic oligonucleotide
agaggcuacggaaacucugauuaca

SEQ ID NO: 5284 - DNA, 25 bp, Artificial Sequence
  Synthetic oligonucleotide
gaggcuacggaaacucugauuacaa

SEQ ID NO: 5285 - DNA, 25 bp, Artificial Sequence
  Synthetic oligonucleotide
aggcuacggaaacucugauuacaaa

SEQ ID NO: 5286 - DNA, 25 bp, Artificial Sequence
  Synthetic oligonucleotide
ggcuacggaaacucugauuacaaac

SEQ ID NO: 5287 - DNA, 25 bp, Artificial Sequence
  Synthetic oligonucleotide
gcuacggaaacucugauuacaaacg

SEQ ID NO: 5288 - DNA, 25 bp, Artificial Sequence
  Synthetic oligonucleotide
cuacggaaacucugauuacaaacgc

SEQ ID NO: 5289 - DNA, 25 bp, Artificial Sequence
  Synthetic oligonucleotide
uacggaaacucugauuacaaacgca

SEQ ID NO: 5290 - DNA, 25 bp, Artificial Sequence
  Synthetic oligonucleotide
acggaaacucugauuacaaacgcat

SEQ ID NO: 5291 - DNA, 25 bp, Artificial Sequence
  Synthetic oligonucleotide
cggaaacucugauuacaaacgcata

SEQ ID NO: 5292 - DNA, 25 bp, Artificial Sequence
  Synthetic oligonucleotide
ggaaacucugauuacaaacgcauag

SEQ ID NO: 5293 - DNA, 25 bp, Artificial Sequence
  Synthetic oligonucleotide
gaaacucugauuacaaacgcauagt

SEQ ID NO: 5294 - DNA, 25 bp, Artificial Sequence
  Synthetic oligonucleotide
aaacucugauuacaaacgcauagta

SEQ ID NO: 5295 - DNA, 25 bp, Artificial Sequence
  Synthetic oligonucleotide
aacucugauuacaaacgcauaguag

SEQ ID NO: 5296 - DNA, 25 bp, Artificial Sequence
  Synthetic oligonucleotide
acucugauuacaaacgcauaguagc

SEQ ID NO: 5297 - DNA, 25 bp, Artificial Sequence
  Synthetic oligonucleotide
cucugauuacaaacgcauaguagca

SEQ ID NO: 5298 - DNA, 25 bp, Artificial Sequence
  Synthetic oligonucleotide
ucugauuacaaacgcauaguagcat

SEQ ID NO: 5299 - DNA, 25 bp, Artificial Sequence
  Synthetic oligonucleotide
cugauuacaaacgcauaguagcatg

SEQ ID NO: 5300 - DNA, 25 bp, Artificial Sequence
  Synthetic oligonucleotide
ugauuacaaacgcauaguagcaugt

SEQ ID NO: 5301 - DNA, 25 bp, Artificial Sequence
  Synthetic oligonucleotide
gauuacaaacgcauaguagcaugtg

SEQ ID NO: 5302 - DNA, 25 bp, Artificial Sequence
  Synthetic oligonucleotide
auuacaaacgcauaguagcaugugc

SEQ ID NO: 5303 - DNA, 25 bp, Artificial Sequence
  Synthetic oligonucleotide
uuacaaacgcauaguagcaugugcc

SEQ ID NO: 5304 - DNA, 25 bp, Artificial Sequence
  Synthetic oligonucleotide
uacaaacgcauaguagcaugugcca

SEQ ID NO: 5305 - DNA, 25 bp, Artificial Sequence
  Synthetic oligonucleotide
acaaacgcauaguagcaugugccag

SEQ ID NO: 5306 - DNA, 25 bp, Artificial Sequence
  Synthetic oligonucleotide
caaacgcauaguagcaugugccagc

SEQ ID NO: 5307 - DNA, 25 bp, Artificial Sequence
  Synthetic oligonucleotide
aaacgcauaguagcaugugccagct

SEQ ID NO: 5308 - DNA, 25 bp, Artificial Sequence
  Synthetic oligonucleotide
aacgcauaguagcaugugccagcta

SEQ ID NO: 5309 - DNA, 25 bp, Artificial Sequence
  Synthetic oligonucleotide
acgcauaguagcaugugccagcuac

SEQ ID NO: 5310 - DNA, 25 bp, Artificial Sequence
  Synthetic oligonucleotide
cgcauaguagcaugugccagcuaca

SEQ ID NO: 5311 - DNA, 25 bp, Artificial Sequence
  Synthetic oligonucleotide
gcauaguagcaugugccagcuacaa

SEQ ID NO: 5312 - DNA, 25 bp, Artificial Sequence
  Synthetic oligonucleotide
cauaguagcaugugccagcuacaag

SEQ ID NO: 5313 - DNA, 25 bp, Artificial Sequence
  Synthetic oligonucleotide
auaguagcaugugccagcuacaagc

SEQ ID NO: 5314 - DNA, 25 bp, Artificial Sequence
  Synthetic oligonucleotide
uaguagcaugugccagcuacaagcc

SEQ ID NO: 5315 - DNA, 25 bp, Artificial Sequence
  Synthetic oligonucleotide
aguagcaugugccagcuacaagccc

SEQ ID NO: 5316 - DNA, 25 bp, Artificial Sequence
  Synthetic oligonucleotide
guagcaugugccagcuacaagccca

SEQ ID NO: 5317 - DNA, 25 bp, Artificial Sequence
  Synthetic oligonucleotide
gugauggacaucuccuugccuactg

SEQ ID NO: 5318 - DNA, 25 bp, Artificial Sequence
  Synthetic oligonucleotide
ugauggacaucuccuugccuacugg

SEQ ID NO: 5319 - DNA, 25 bp, Artificial Sequence
  Synthetic oligonucleotide
gauggacaucuccuugccuacugga

SEQ ID NO: 5320 - DNA, 25 bp, Artificial Sequence
  Synthetic oligonucleotide
auggacaucuccuugccuacuggaa

SEQ ID NO: 5321 - DNA, 25 bp, Artificial Sequence
  Synthetic oligonucleotide
uggacaucuccuugccuacuggaat

SEQ ID NO: 5322 - DNA, 25 bp, Artificial Sequence
  Synthetic oligonucleotide
ggacaucuccuugccuacuggaatc

SEQ ID NO: 5323 - DNA, 25 bp, Artificial Sequence
  Synthetic oligonucleotide
gacaucuccuugccuacuggaauca

SEQ ID NO: 5324 - DNA, 25 bp, Artificial Sequence
  Synthetic oligonucleotide
acaucuccuugccuacuggaaucag

SEQ ID NO: 5325 - DNA, 25 bp, Artificial Sequence
  Synthetic oligonucleotide
caucuccuugccuacuggaaucagt

SEQ ID NO: 5326 - DNA, 25 bp, Artificial Sequence
  Synthetic oligonucleotide
aucuccuugccuacuggaaucagtg

SEQ ID NO: 5327 - DNA, 25 bp, Artificial Sequence
  Synthetic oligonucleotide
ucuccuugccuacuggaaucagugc

SEQ ID NO: 5328 - DNA, 25 bp, Artificial Sequence
  Synthetic oligonucleotide
cuccuugccuacuggaaucagugca

SEQ ID NO: 5329 - DNA, 25 bp, Artificial Sequence
  Synthetic oligonucleotide
uccuugccuacuggaaucagugcaa

SEQ ID NO: 5330 - DNA, 25 bp, Artificial Sequence
  Synthetic oligonucleotide
ugcaaaugaagaagacuuaaaagcc

SEQ ID NO: 5331 - DNA, 25 bp, Artificial Sequence
  Synthetic oligonucleotide
gcaaaugaagaagacuuaaaagccc

SEQ ID NO: 5332 - DNA, 25 bp, Artificial Sequence
  Synthetic oligonucleotide
caaaugaagaagacuuaaaagccct

SEQ ID NO: 5333 - DNA, 25 bp, Artificial Sequence
  Synthetic oligonucleotide
aaaugaagaagacuuaaaagccctt

SEQ ID NO: 5334 - DNA, 25 bp, Artificial Sequence
  Synthetic oligonucleotide
aaugaagaagacuuaaaagcccutg

SEQ ID NO: 5335 - DNA, 25 bp, Artificial Sequence
  Synthetic oligonucleotide
augaagaagacuuaaaagcccuugt

SEQ ID NO: 5336 - DNA, 25 bp, Artificial Sequence
  Synthetic oligonucleotide
cuuguggaagggguggaucaacuat

SEQ ID NO: 5337 - DNA, 25 bp, Artificial Sequence
  Synthetic oligonucleotide
uuguggaagggguggaucaacuatt

SEQ ID NO: 5338 - DNA, 25 bp, Artificial Sequence
  Synthetic oligonucleotide
cuauucacugauuaccaaaucaaag

SEQ ID NO: 5339 - DNA, 25 bp, Artificial Sequence
  Synthetic oligonucleotide
uauucacugauuaccaaaucaaaga

SEQ ID NO: 5340 - DNA, 25 bp, Artificial Sequence
  Synthetic oligonucleotide
aaagauggacauguuauucugcaac

SEQ ID NO: 5341 - DNA, 25 bp, Artificial Sequence
  Synthetic oligonucleotide
aagauggacauguuauucugcaact

SEQ ID NO: 5342 - DNA, 25 bp, Artificial Sequence
  Synthetic oligonucleotide
agauggacauguuauucugcaactg

SEQ ID NO: 5343 - DNA, 25 bp, Artificial Sequence
  Synthetic oligonucleotide
uggacauguuauucugcaacugaat

SEQ ID NO: 5344 - DNA, 25 bp, Artificial Sequence
  Synthetic oligonucleotide
gacauguuauucugcaacugaautc

SEQ ID NO: 5345 - DNA, 25 bp, Artificial Sequence
  Synthetic oligonucleotide
uguuauucugcaacugaauucgatt

SEQ ID NO: 5346 - DNA, 25 bp, Artificial Sequence
  Synthetic oligonucleotide
guuauucugcaacugaauucgautc

SEQ ID NO: 5347 - DNA, 25 bp, Artificial Sequence
  Synthetic oligonucleotide
uuauucugcaacugaauucgauucc

SEQ ID NO: 5348 - DNA, 25 bp, Artificial Sequence
  Synthetic oligonucleotide
uauucugcaacugaauucgauuccc

SEQ ID NO: 5349 - DNA, 25 bp, Artificial Sequence
  Synthetic oligonucleotide
uuugaacucuuugaaguuggguutc

SEQ ID NO: 5350 - DNA, 25 bp, Artificial Sequence
  Synthetic oligonucleotide
uugaacucuuugaaguuggguuuct

SEQ ID NO: 5351 - DNA, 25 bp, Artificial Sequence
  Synthetic oligonucleotide
ugaacucuuugaaguuggguuuctc

SEQ ID NO: 5352 - DNA, 25 bp, Artificial Sequence
  Synthetic oligonucleotide
gaacucuuugaaguuggguuucuca

SEQ ID NO: 5353 - DNA, 25 bp, Artificial Sequence
  Synthetic oligonucleotide
aacucuuugaaguuggguuucucag

SEQ ID NO: 5354 - DNA, 25 bp, Artificial Sequence
  Synthetic oligonucleotide
acucuuugaaguuggguuucucagt

SEQ ID NO: 5355 - DNA, 25 bp, Artificial Sequence
  Synthetic oligonucleotide
cucuuugaaguuggguuucucagtc

SEQ ID NO: 5356 - DNA, 25 bp, Artificial Sequence
  Synthetic oligonucleotide
ucuuugaaguuggguuucucagucc

SEQ ID NO: 5357 - DNA, 25 bp, Artificial Sequence
  Synthetic oligonucleotide
aguccugccacuuucacaguguacg

SEQ ID NO: 5358 - DNA, 25 bp, Artificial Sequence
  Synthetic oligonucleotide
guccugccacuuucacaguguacga

SEQ ID NO: 5359 - DNA, 25 bp, Artificial Sequence
  Synthetic oligonucleotide
uccugccacuuucacaguguacgaa

SEQ ID NO: 5360 - DNA, 25 bp, Artificial Sequence
  Synthetic oligonucleotide
ccugccacuuucacaguguacgaat

SEQ ID NO: 5361 - DNA, 25 bp, Artificial Sequence
  Synthetic oligonucleotide
cugccacuuucacaguguacgaata

SEQ ID NO: 5362 - DNA, 25 bp, Artificial Sequence
  Synthetic oligonucleotide
gaauaccacagaccagauaaacagt

SEQ ID NO: 5363 - DNA, 25 bp, Artificial Sequence
  Synthetic oligonucleotide
aauaccacagaccagauaaacagtg

SEQ ID NO: 5364 - DNA, 25 bp, Artificial Sequence
  Synthetic oligonucleotide
auaccacagaccagauaaacagugt

SEQ ID NO: 5365 - DNA, 25 bp, Artificial Sequence
  Synthetic oligonucleotide
uaccacagaccagauaaacagugta

SEQ ID NO: 5366 - DNA, 25 bp, Artificial Sequence
  Synthetic oligonucleotide
accacagaccagauaaacaguguac

SEQ ID NO: 5367 - DNA, 25 bp, Artificial Sequence
  Synthetic oligonucleotide
ccacagaccagauaaacaguguacc

SEQ ID NO: 5368 - DNA, 25 bp, Artificial Sequence
  Synthetic oligonucleotide
cacagaccagauaaacaguguacca

SEQ ID NO: 5369 - DNA, 25 bp, Artificial Sequence
  Synthetic oligonucleotide
acagaccagauaaacaguguaccat

SEQ ID NO: 5370 - DNA, 25 bp, Artificial Sequence
  Synthetic oligonucleotide
cagaccagauaaacaguguaccatg

SEQ ID NO: 5371 - DNA, 25 bp, Artificial Sequence
  Synthetic oligonucleotide
agaccagauaaacaguguaccaugt

SEQ ID NO: 5372 - DNA, 25 bp, Artificial Sequence
  Synthetic oligonucleotide
gaccagauaaacaguguaccaugtt

SEQ ID NO: 5373 - DNA, 25 bp, Artificial Sequence
  Synthetic oligonucleotide
accagauaaacaguguaccaugutt

SEQ ID NO: 5374 - DNA, 25 bp, Artificial Sequence
  Synthetic oligonucleotide
ccagauaaacaguguaccauguutt

SEQ ID NO: 5375 - DNA, 25 bp, Artificial Sequence
  Synthetic oligonucleotide
cagauaaacaguguaccauguuuta

SEQ ID NO: 5376 - DNA, 25 bp, Artificial Sequence
  Synthetic oligonucleotide
agauaaacaguguaccauguuuuat

SEQ ID NO: 5377 - DNA, 25 bp, Artificial Sequence
  Synthetic oligonucleotide
uaaacaguguaccauguuuuauagc

SEQ ID NO: 5378 - DNA, 25 bp, Artificial Sequence
  Synthetic oligonucleotide
aacaguguaccauguuuuauagcac

SEQ ID NO: 5379 - DNA, 25 bp, Artificial Sequence
  Synthetic oligonucleotide
caguguaccauguuuuauagcactt

SEQ ID NO: 5380 - DNA, 25 bp, Artificial Sequence
  Synthetic oligonucleotide
aguguaccauguuuuauagcacutc

SEQ ID NO: 5381 - DNA, 25 bp, Artificial Sequence
  Synthetic oligonucleotide
guguaccauguuuuauagcacuucc

SEQ ID NO: 5382 - DNA, 25 bp, Artificial Sequence
  Synthetic oligonucleotide
uguaccauguuuuauagcacuucca

SEQ ID NO: 5383 - DNA, 25 bp, Artificial Sequence
  Synthetic oligonucleotide
guaccauguuuuauagcacuuccaa

SEQ ID NO: 5384 - DNA, 25 bp, Artificial Sequence
  Synthetic oligonucleotide
uaccauguuuuauagcacuuccaat

SEQ ID NO: 5385 - DNA, 25 bp, Artificial Sequence
  Synthetic oligonucleotide
accauguuuuauagcacuuccaata

SEQ ID NO: 5386 - DNA, 25 bp, Artificial Sequence
  Synthetic oligonucleotide
ccauguuuuauagcacuuccaauat

SEQ ID NO: 5387 - DNA, 25 bp, Artificial Sequence
  Synthetic oligonucleotide
cauguuuuauagcacuuccaauatc

SEQ ID NO: 5388 - DNA, 25 bp, Artificial Sequence
  Synthetic oligonucleotide
auguuuuauagcacuuccaauauca

SEQ ID NO: 5389 - DNA, 25 bp, Artificial Sequence
  Synthetic oligonucleotide
uguuuuauagcacuuccaauaucaa

SEQ ID NO: 5390 - DNA, 25 bp, Artificial Sequence
  Synthetic oligonucleotide
guuuuauagcacuuccaauaucaaa

SEQ ID NO: 5391 - DNA, 25 bp, Artificial Sequence
  Synthetic oligonucleotide
uuuuauagcacuuccaauaucaaaa

SEQ ID NO: 5392 - DNA, 25 bp, Artificial Sequence
  Synthetic oligonucleotide
uuuauagcacuuccaauaucaaaat

SEQ ID NO: 5393 - DNA, 25 bp, Artificial Sequence
  Synthetic oligonucleotide
uuauagcacuuccaauaucaaaatt

SEQ ID NO: 5394 - DNA, 25 bp, Artificial Sequence
  Synthetic oligonucleotide
uauagcacuuccaauaucaaaautc

SEQ ID NO: 5395 - DNA, 25 bp, Artificial Sequence
  Synthetic oligonucleotide
uagcacuuccaauaucaaaauucag

SEQ ID NO: 5396 - DNA, 25 bp, Artificial Sequence
  Synthetic oligonucleotide
agcacuuccaauaucaaaauucaga

SEQ ID NO: 5397 - DNA, 25 bp, Artificial Sequence
  Synthetic oligonucleotide
gcacuuccaauaucaaaauucagaa

SEQ ID NO: 5398 - DNA, 25 bp, Artificial Sequence
  Synthetic oligonucleotide
cacuuccaauaucaaaauucagaaa

SEQ ID NO: 5399 - DNA, 25 bp, Artificial Sequence
  Synthetic oligonucleotide
acuuccaauaucaaaauucagaaag

SEQ ID NO: 5400 - DNA, 25 bp, Artificial Sequence
  Synthetic oligonucleotide
cuuccaauaucaaaauucagaaagt

SEQ ID NO: 5401 - DNA, 25 bp, Artificial Sequence
  Synthetic oligonucleotide
uuccaauaucaaaauucagaaagtc

SEQ ID NO: 5402 - DNA, 25 bp, Artificial Sequence
  Synthetic oligonucleotide
uccaauaucaaaauucagaaaguct

SEQ ID NO: 5403 - DNA, 25 bp, Artificial Sequence
  Synthetic oligonucleotide
ccaauaucaaaauucagaaaguctg

SEQ ID NO: 5404 - DNA, 25 bp, Artificial Sequence
  Synthetic oligonucleotide
caauaucaaaauucagaaagucugt

SEQ ID NO: 5405 - DNA, 25 bp, Artificial Sequence
  Synthetic oligonucleotide
aauaucaaaauucagaaagucugtg

SEQ ID NO: 5406 - DNA, 25 bp, Artificial Sequence
  Synthetic oligonucleotide
auaucaaaauucagaaagucuguga

SEQ ID NO: 5407 - DNA, 25 bp, Artificial Sequence
  Synthetic oligonucleotide
uaucaaaauucagaaagucugugaa

SEQ ID NO: 5408 - DNA, 25 bp, Artificial Sequence
  Synthetic oligonucleotide
aucaaaauucagaaagucugugaag

SEQ ID NO: 5409 - DNA, 25 bp, Artificial Sequence
  Synthetic oligonucleotide
ucaaaauucagaaagucugugaagg

SEQ ID NO: 5410 - DNA, 25 bp, Artificial Sequence
  Synthetic oligonucleotide
caaaauucagaaagucugugaagga

SEQ ID NO: 5411 - DNA, 25 bp, Artificial Sequence
  Synthetic oligonucleotide
aaaauucagaaagucugugaaggag

SEQ ID NO: 5412 - DNA, 25 bp, Artificial Sequence
  Synthetic oligonucleotide
aaauucagaaagucugugaaggagc

SEQ ID NO: 5413 - DNA, 25 bp, Artificial Sequence
  Synthetic oligonucleotide
aauucagaaagucugugaaggagcc

SEQ ID NO: 5414 - DNA, 25 bp, Artificial Sequence
  Synthetic oligonucleotide
auucagaaagucugugaaggagccg

SEQ ID NO: 5415 - DNA, 25 bp, Artificial Sequence
  Synthetic oligonucleotide
gaaagucugugaaggagccgcgugc

SEQ ID NO: 5416 - DNA, 25 bp, Artificial Sequence
  Synthetic oligonucleotide
uagaagcugauugugggcaaaugca

SEQ ID NO: 5417 - DNA, 25 bp, Artificial Sequence
  Synthetic oligonucleotide
agaagcugauugugggcaaaugcag

SEQ ID NO: 5418 - DNA, 25 bp, Artificial Sequence
  Synthetic oligonucleotide
gaagcugauugugggcaaaugcagg

SEQ ID NO: 5419 - DNA, 25 bp, Artificial Sequence
  Synthetic oligonucleotide
aagcugauugugggcaaaugcagga

SEQ ID NO: 5420 - DNA, 25 bp, Artificial Sequence
  Synthetic oligonucleotide
agcugauugugggcaaaugcaggaa

SEQ ID NO: 5421 - DNA, 25 bp, Artificial Sequence
  Synthetic oligonucleotide
gcugauugugggcaaaugcaggaag

SEQ ID NO: 5422 - DNA, 25 bp, Artificial Sequence
  Synthetic oligonucleotide
cugauugugggcaaaugcaggaaga

SEQ ID NO: 5423 - DNA, 25 bp, Artificial Sequence
  Synthetic oligonucleotide
ugauugugggcaaaugcaggaagaa

SEQ ID NO: 5424 - DNA, 25 bp, Artificial Sequence
  Synthetic oligonucleotide
aagaauuggaucugacaaucucugc

SEQ ID NO: 5425 - DNA, 25 bp, Artificial Sequence
  Synthetic oligonucleotide
agaauuggaucugacaaucucugca

SEQ ID NO: 5426 - DNA, 25 bp, Artificial Sequence
  Synthetic oligonucleotide
gaauuggaucugacaaucucugcag

SEQ ID NO: 5427 - DNA, 25 bp, Artificial Sequence
  Synthetic oligonucleotide
aauuggaucugacaaucucugcaga

SEQ ID NO: 5428 - DNA, 25 bp, Artificial Sequence
  Synthetic oligonucleotide
auuggaucugacaaucucugcagag

SEQ ID NO: 5429 - DNA, 25 bp, Artificial Sequence
  Synthetic oligonucleotide
uuggaucugacaaucucugcagaga

SEQ ID NO: 5430 - DNA, 25 bp, Artificial Sequence
  Synthetic oligonucleotide
uggaucugacaaucucugcagagac

SEQ ID NO: 5431 - DNA, 25 bp, Artificial Sequence
  Synthetic oligonucleotide
ggaucugacaaucucugcagagaca

SEQ ID NO: 5432 - DNA, 25 bp, Artificial Sequence
  Synthetic oligonucleotide
gaucugacaaucucugcagagacaa

SEQ ID NO: 5433 - DNA, 25 bp, Artificial Sequence
  Synthetic oligonucleotide
aucugacaaucucugcagagacaag

SEQ ID NO: 5434 - DNA, 25 bp, Artificial Sequence
  Synthetic oligonucleotide
ucugacaaucucugcagagacaaga

SEQ ID NO: 5435 - DNA, 25 bp, Artificial Sequence
  Synthetic oligonucleotide
cugacaaucucugcagagacaagaa

SEQ ID NO: 5436 - DNA, 25 bp, Artificial Sequence
  Synthetic oligonucleotide
ugacaaucucugcagagacaagaaa

SEQ ID NO: 5437 - DNA, 25 bp, Artificial Sequence
  Synthetic oligonucleotide
agaaaacaaacagcauguaaaccag

SEQ ID NO: 5438 - DNA, 25 bp, Artificial Sequence
  Synthetic oligonucleotide
gaaaacaaacagcauguaaaccaga

SEQ ID NO: 5439 - DNA, 25 bp, Artificial Sequence
  Synthetic oligonucleotide
gauugcauaugcuuauaaaguuagc

SEQ ID NO: 5440 - DNA, 25 bp, Artificial Sequence
  Synthetic oligonucleotide
auugcauaugcuuauaaaguuagca

SEQ ID NO: 5441 - DNA, 25 bp, Artificial Sequence
  Synthetic oligonucleotide
uugcauaugcuuauaaaguuagcat

SEQ ID NO: 5442 - DNA, 25 bp, Artificial Sequence
  Synthetic oligonucleotide
ugcauaugcuuauaaaguuagcatc

SEQ ID NO: 5443 - DNA, 25 bp, Artificial Sequence
  Synthetic oligonucleotide
gcauaugcuuauaaaguuagcauca

SEQ ID NO: 5444 - DNA, 25 bp, Artificial Sequence
  Synthetic oligonucleotide
auguuuuugucaaguacaaggcaac

SEQ ID NO: 5445 - DNA, 25 bp, Artificial Sequence
  Synthetic oligonucleotide
uguuuuugucaaguacaaggcaacc

SEQ ID NO: 5446 - DNA, 25 bp, Artificial Sequence
  Synthetic oligonucleotide
guuuuugucaaguacaaggcaaccc

SEQ ID NO: 5447 - DNA, 25 bp, Artificial Sequence
  Synthetic oligonucleotide
uuuuugucaaguacaaggcaaccct

SEQ ID NO: 5448 - DNA, 25 bp, Artificial Sequence
  Synthetic oligonucleotide
uuuugucaaguacaaggcaaccctt

SEQ ID NO: 5449 - DNA, 25 bp, Artificial Sequence
  Synthetic oligonucleotide
uuugucaaguacaaggcaacccutc

SEQ ID NO: 5450 - DNA, 25 bp, Artificial Sequence
  Synthetic oligonucleotide
uugucaaguacaaggcaacccuuct

SEQ ID NO: 5451 - DNA, 25 bp, Artificial Sequence
  Synthetic oligonucleotide
ugucaaguacaaggcaacccuuctg

SEQ ID NO: 5452 - DNA, 25 bp, Artificial Sequence
  Synthetic oligonucleotide
gucaaguacaaggcaacccuucugg

SEQ ID NO: 5453 - DNA, 25 bp, Artificial Sequence
  Synthetic oligonucleotide
ucaaguacaaggcaacccuucugga

SEQ ID NO: 5454 - DNA, 25 bp, Artificial Sequence
  Synthetic oligonucleotide
caaguacaaggcaacccuucuggat

SEQ ID NO: 5455 - DNA, 25 bp, Artificial Sequence
  Synthetic oligonucleotide
aaguacaaggcaacccuucuggata

SEQ ID NO: 5456 - DNA, 25 bp, Artificial Sequence
  Synthetic oligonucleotide
aguacaaggcaacccuucuggauat

SEQ ID NO: 5457 - DNA, 25 bp, Artificial Sequence
  Synthetic oligonucleotide
guacaaggcaacccuucuggauatc

SEQ ID NO: 5458 - DNA, 25 bp, Artificial Sequence
  Synthetic oligonucleotide
uacaaggcaacccuucuggauauct

SEQ ID NO: 5459 - DNA, 25 bp, Artificial Sequence
  Synthetic oligonucleotide
acaaggcaacccuucuggauaucta

SEQ ID NO: 5460 - DNA, 25 bp, Artificial Sequence
  Synthetic oligonucleotide
caaggcaacccuucuggauaucuac

SEQ ID NO: 5461 - DNA, 25 bp, Artificial Sequence
  Synthetic oligonucleotide
aaggcaacccuucuggauaucuaca

SEQ ID NO: 5462 - DNA, 25 bp, Artificial Sequence
  Synthetic oligonucleotide
aggcaacccuucuggauaucuacaa

SEQ ID NO: 5463 - DNA, 25 bp, Artificial Sequence
  Synthetic oligonucleotide
ggcaacccuucuggauaucuacaaa

SEQ ID NO: 5464 - DNA, 25 bp, Artificial Sequence
  Synthetic oligonucleotide
gcaacccuucuggauaucuacaaaa

SEQ ID NO: 5465 - DNA, 25 bp, Artificial Sequence
  Synthetic oligonucleotide
caacccuucuggauaucuacaaaac

SEQ ID NO: 5466 - DNA, 25 bp, Artificial Sequence
  Synthetic oligonucleotide
aacccuucuggauaucuacaaaact

SEQ ID NO: 5467 - DNA, 25 bp, Artificial Sequence
  Synthetic oligonucleotide
acccuucuggauaucuacaaaactg

SEQ ID NO: 5468 - DNA, 25 bp, Artificial Sequence
  Synthetic oligonucleotide
cccuucuggauaucuacaaaacugg

SEQ ID NO: 5469 - DNA, 25 bp, Artificial Sequence
  Synthetic oligonucleotide
ccuucuggauaucuacaaaacuggg

SEQ ID NO: 5470 - DNA, 25 bp, Artificial Sequence
  Synthetic oligonucleotide
cuucuggauaucuacaaaacugggg

SEQ ID NO: 5471 - DNA, 25 bp, Artificial Sequence
  Synthetic oligonucleotide
uucuggauaucuacaaaacugggga

SEQ ID NO: 5472 - DNA, 25 bp, Artificial Sequence
  Synthetic oligonucleotide
ucuggauaucuacaaaacuggggaa

SEQ ID NO: 5473 - DNA, 25 bp, Artificial Sequence
  Synthetic oligonucleotide
cuggauaucuacaaaacuggggaag

SEQ ID NO: 5474 - DNA, 25 bp, Artificial Sequence
  Synthetic oligonucleotide
uggauaucuacaaaacuggggaagc

SEQ ID NO: 5475 - DNA, 25 bp, Artificial Sequence
  Synthetic oligonucleotide
ggauaucuacaaaacuggggaagct

SEQ ID NO: 5476 - DNA, 25 bp, Artificial Sequence
  Synthetic oligonucleotide
gauaucuacaaaacuggggaagctg

SEQ ID NO: 5477 - DNA, 25 bp, Artificial Sequence
  Synthetic oligonucleotide
auaucuacaaaacuggggaagcugt

SEQ ID NO: 5478 - DNA, 25 bp, Artificial Sequence
  Synthetic oligonucleotide
uaucuacaaaacuggggaagcugtt

SEQ ID NO: 5479 - DNA, 25 bp, Artificial Sequence
  Synthetic oligonucleotide
aucuacaaaacuggggaagcugutg

SEQ ID NO: 5480 - DNA, 25 bp, Artificial Sequence
  Synthetic oligonucleotide
ucuacaaaacuggggaagcuguugc

SEQ ID NO: 5481 - DNA, 25 bp, Artificial Sequence
  Synthetic oligonucleotide
cuacaaaacuggggaagcuguugct

SEQ ID NO: 5482 - DNA, 25 bp, Artificial Sequence
  Synthetic oligonucleotide
uacaaaacuggggaagcuguugctg

SEQ ID NO: 5483 - DNA, 25 bp, Artificial Sequence
  Synthetic oligonucleotide
acaaaacuggggaagcuguugcuga

SEQ ID NO: 5484 - DNA, 25 bp, Artificial Sequence
  Synthetic oligonucleotide
caaaacuggggaagcuguugcugag

SEQ ID NO: 5485 - DNA, 25 bp, Artificial Sequence
  Synthetic oligonucleotide
aaaacuggggaagcuguugcugaga

SEQ ID NO: 5486 - DNA, 25 bp, Artificial Sequence
  Synthetic oligonucleotide
aaacuggggaagcuguugcugagaa

SEQ ID NO: 5487 - DNA, 25 bp, Artificial Sequence
  Synthetic oligonucleotide
aacuggggaagcuguugcugagaaa

SEQ ID NO: 5488 - DNA, 25 bp, Artificial Sequence
  Synthetic oligonucleotide
acuggggaagcuguugcugagaaag

SEQ ID NO: 5489 - DNA, 25 bp, Artificial Sequence
  Synthetic oligonucleotide
cuggggaagcuguugcugagaaaga

SEQ ID NO: 5490 - DNA, 25 bp, Artificial Sequence
  Synthetic oligonucleotide
accuucauuaaaaagguaaccugta

SEQ ID NO: 5491 - DNA, 25 bp, Artificial Sequence
  Synthetic oligonucleotide
ccuucauuaaaaagguaaccuguac

SEQ ID NO: 5492 - DNA, 25 bp, Artificial Sequence
  Synthetic oligonucleotide
cuucauuaaaaagguaaccuguact

SEQ ID NO: 5493 - DNA, 25 bp, Artificial Sequence
  Synthetic oligonucleotide
uucauuaaaaagguaaccuguacta

SEQ ID NO: 5494 - DNA, 25 bp, Artificial Sequence
  Synthetic oligonucleotide
ucauuaaaaagguaaccuguacuaa

SEQ ID NO: 5495 - DNA, 25 bp, Artificial Sequence
  Synthetic oligonucleotide
aaaggaagacaguacuuaauuaugg

SEQ ID NO: 5496 - DNA, 25 bp, Artificial Sequence
  Synthetic oligonucleotide
aaggaagacaguacuuaauuauggg

SEQ ID NO: 5497 - DNA, 25 bp, Artificial Sequence
  Synthetic oligonucleotide
aggaagacaguacuuaauuaugggt

SEQ ID NO: 5498 - DNA, 25 bp, Artificial Sequence
  Synthetic oligonucleotide
ggaagacaguacuuaauuaugggta

SEQ ID NO: 5499 - DNA, 25 bp, Artificial Sequence
  Synthetic oligonucleotide
gaagacaguacuuaauuauggguaa

SEQ ID NO: 5500 - DNA, 25 bp, Artificial Sequence
  Synthetic oligonucleotide
aagacaguacuuaauuauggguaaa

SEQ ID NO: 5501 - DNA, 25 bp, Artificial Sequence
  Synthetic oligonucleotide
agacaguacuuaauuauggguaaag

SEQ ID NO: 5502 - DNA, 25 bp, Artificial Sequence
  Synthetic oligonucleotide
gacaguacuuaauuauggguaaaga

SEQ ID NO: 5503 - DNA, 25 bp, Artificial Sequence
  Synthetic oligonucleotide
cuccagauaaaauacaauuucagtt

SEQ ID NO: 5504 - DNA, 25 bp, Artificial Sequence
  Synthetic oligonucleotide
uccagauaaaauacaauuucagutt

SEQ ID NO: 5505 - DNA, 25 bp, Artificial Sequence
  Synthetic oligonucleotide
cagauaaaauacaauuucaguuuca

SEQ ID NO: 5506 - DNA, 25 bp, Artificial Sequence
  Synthetic oligonucleotide
uuucagguacaucuacccuuuagat

SEQ ID NO: 5507 - DNA, 25 bp, Artificial Sequence
  Synthetic oligonucleotide
uucagguacaucuacccuuuagatt

SEQ ID NO: 5508 - DNA, 25 bp, Artificial Sequence
  Synthetic oligonucleotide
ucagguacaucuacccuuuagautc

SEQ ID NO: 5509 - DNA, 25 bp, Artificial Sequence
  Synthetic oligonucleotide
cagguacaucuacccuuuagauucc

SEQ ID NO: 5510 - DNA, 25 bp, Artificial Sequence
  Synthetic oligonucleotide
agguacaucuacccuuuagauucct

SEQ ID NO: 5511 - DNA, 25 bp, Artificial Sequence
  Synthetic oligonucleotide
gguacaucuacccuuuagauucctt

SEQ ID NO: 5512 - DNA, 25 bp, Artificial Sequence
  Synthetic oligonucleotide
guacaucuacccuuuagauuccutg

SEQ ID NO: 5513 - DNA, 25 bp, Artificial Sequence
  Synthetic oligonucleotide
uacaucuacccuuuagauuccuuga

SEQ ID NO: 5514 - DNA, 25 bp, Artificial Sequence
  Synthetic oligonucleotide
acaucuacccuuuagauuccuugac

SEQ ID NO: 5515 - DNA, 25 bp, Artificial Sequence
  Synthetic oligonucleotide
caucuacccuuuagauuccuugacc

SEQ ID NO: 5516 - DNA, 25 bp, Artificial Sequence
  Synthetic oligonucleotide
aucuacccuuuagauuccuugacct

SEQ ID NO: 5517 - DNA, 25 bp, Artificial Sequence
  Synthetic oligonucleotide
ucuacccuuuagauuccuugacctg

SEQ ID NO: 5518 - DNA, 25 bp, Artificial Sequence
  Synthetic oligonucleotide
cuacccuuuagauuccuugaccugg

SEQ ID NO: 5519 - DNA, 25 bp, Artificial Sequence
  Synthetic oligonucleotide
uacccuuuagauuccuugaccugga

SEQ ID NO: 5520 - DNA, 25 bp, Artificial Sequence
  Synthetic oligonucleotide
acccuuuagauuccuugaccuggat

SEQ ID NO: 5521 - DNA, 25 bp, Artificial Sequence
  Synthetic oligonucleotide
cccuuuagauuccuugaccuggatt

SEQ ID NO: 5522 - DNA, 25 bp, Artificial Sequence
  Synthetic oligonucleotide
ccuuuagauuccuugaccuggautg

SEQ ID NO: 5523 - DNA, 25 bp, Artificial Sequence
  Synthetic oligonucleotide
cuuuagauuccuugaccuggauuga

SEQ ID NO: 5524 - DNA, 25 bp, Artificial Sequence
  Synthetic oligonucleotide
uuuagauuccuugaccuggauugaa

SEQ ID NO: 5525 - DNA, 25 bp, Artificial Sequence
  Synthetic oligonucleotide
uuagauuccuugaccuggauugaat

SEQ ID NO: 5526 - DNA, 25 bp, Artificial Sequence
  Synthetic oligonucleotide
uagauuccuugaccuggauugaata

SEQ ID NO: 5527 - DNA, 25 bp, Artificial Sequence
  Synthetic oligonucleotide
agauuccuugaccuggauugaauac

SEQ ID NO: 5528 - DNA, 25 bp, Artificial Sequence
  Synthetic oligonucleotide
gauuccuugaccuggauugaauact

SEQ ID NO: 5529 - DNA, 25 bp, Artificial Sequence
  Synthetic oligonucleotide
auuccuugaccuggauugaauactg

SEQ ID NO: 5530 - DNA, 25 bp, Artificial Sequence
  Synthetic oligonucleotide
uuccuugaccuggauugaauacugg

SEQ ID NO: 5531 - DNA, 25 bp, Artificial Sequence
  Synthetic oligonucleotide
uccuugaccuggauugaauacuggc

SEQ ID NO: 5532 - DNA, 25 bp, Artificial Sequence
  Synthetic oligonucleotide
ccuugaccuggauugaauacuggcc

SEQ ID NO: 5533 - DNA, 25 bp, Artificial Sequence
  Synthetic oligonucleotide
cuugaccuggauugaauacuggcct

SEQ ID NO: 5534 - DNA, 25 bp, Artificial Sequence
  Synthetic oligonucleotide
uugaccuggauugaauacuggccta

SEQ ID NO: 5535 - DNA, 25 bp, Artificial Sequence
  Synthetic oligonucleotide
ugaccuggauugaauacuggccuag

SEQ ID NO: 5536 - DNA, 25 bp, Artificial Sequence
  Synthetic oligonucleotide
gaccuggauugaauacuggccuaga

SEQ ID NO: 5537 - DNA, 25 bp, Artificial Sequence
  Synthetic oligonucleotide
accuggauugaauacuggccuagag

SEQ ID NO: 5538 - DNA, 25 bp, Artificial Sequence
  Synthetic oligonucleotide
ccuggauugaauacuggccuagaga

SEQ ID NO: 5539 - DNA, 25 bp, Artificial Sequence
  Synthetic oligonucleotide
cuggauugaauacuggccuagagac

SEQ ID NO: 5540 - DNA, 25 bp, Artificial Sequence
  Synthetic oligonucleotide
uggauugaauacuggccuagagaca

SEQ ID NO: 5541 - DNA, 25 bp, Artificial Sequence
  Synthetic oligonucleotide
ggauugaauacuggccuagagacac

SEQ ID NO: 5542 - DNA, 25 bp, Artificial Sequence
  Synthetic oligonucleotide
caacauguucaucgugucaagcatt

SEQ ID NO: 5543 - DNA, 25 bp, Artificial Sequence
  Synthetic oligonucleotide
aacauguucaucgugucaagcautt

SEQ ID NO: 5544 - DNA, 25 bp, Artificial Sequence
  Synthetic oligonucleotide
acauguucaucgugucaagcauutt

SEQ ID NO: 5545 - DNA, 25 bp, Artificial Sequence
  Synthetic oligonucleotide
cauguucaucgugucaagcauuutt

SEQ ID NO: 5546 - DNA, 25 bp, Artificial Sequence
  Synthetic oligonucleotide
uguucaucgugucaagcauuuuuag

SEQ ID NO: 5547 - DNA, 25 bp, Artificial Sequence
  Synthetic oligonucleotide
guucaucgugucaagcauuuuuagc

SEQ ID NO: 5548 - DNA, 25 bp, Artificial Sequence
  Synthetic oligonucleotide
uucaucgugucaagcauuuuuagct

SEQ ID NO: 5549 - DNA, 25 bp, Artificial Sequence
  Synthetic oligonucleotide
ucaucgugucaagcauuuuuagcta

SEQ ID NO: 5550 - DNA, 25 bp, Artificial Sequence
  Synthetic oligonucleotide
aucgugucaagcauuuuuagcuaat

SEQ ID NO: 5551 - DNA, 25 bp, Artificial Sequence
  Synthetic oligonucleotide
ucgugucaagcauuuuuagcuaatt

SEQ ID NO: 5552 - DNA, 25 bp, Artificial Sequence
  Synthetic oligonucleotide
cgugucaagcauuuuuagcuaautt

SEQ ID NO: 5553 - DNA, 25 bp, Artificial Sequence
  Synthetic oligonucleotide
ugucaagcauuuuuagcuaauuuag

SEQ ID NO: 5554 - DNA, 25 bp, Artificial Sequence
  Synthetic oligonucleotide
gucaagcauuuuuagcuaauuuaga

SEQ ID NO: 5555 - DNA, 25 bp, Artificial Sequence
  Synthetic oligonucleotide
ucaagcauuuuuagcuaauuuagat

SEQ ID NO: 5556 - DNA, 25 bp, Artificial Sequence
  Synthetic oligonucleotide
caagcauuuuuagcuaauuuagatg

SEQ ID NO: 5557 - DNA, 25 bp, Artificial Sequence
  Synthetic oligonucleotide
agcauuuuuagcuaauuuagaugaa

SEQ ID NO: 5558 - DNA, 25 bp, Artificial Sequence
  Synthetic oligonucleotide
gcauuuuuagcuaauuuagaugaat

SEQ ID NO: 5559 - DNA, 25 bp, Artificial Sequence
  Synthetic oligonucleotide
cauuuuuagcuaauuuagaugaatt

SEQ ID NO: 5560 - DNA, 25 bp, Artificial Sequence
  Synthetic oligonucleotide
auuuuuagcuaauuuagaugaautt

SEQ ID NO: 5561 - DNA, 25 bp, Artificial Sequence
  Synthetic oligonucleotide
uuuuuagcuaauuuagaugaauutg

SEQ ID NO: 5562 - DNA, 25 bp, Artificial Sequence
  Synthetic oligonucleotide
uuuuagcuaauuuagaugaauuugc

SEQ ID NO: 5563 - DNA, 25 bp, Artificial Sequence
  Synthetic oligonucleotide
uuuagcuaauuuagaugaauuugcc

SEQ ID NO: 5564 - DNA, 25 bp, Artificial Sequence
  Synthetic oligonucleotide
uuagcuaauuuagaugaauuugccg

SEQ ID NO: 5565 - DNA, 25 bp, Artificial Sequence
  Synthetic oligonucleotide
uagcuaauuuagaugaauuugccga

SEQ ID NO: 5566 - DNA, 25 bp, Artificial Sequence
  Synthetic oligonucleotide
agcuaauuuagaugaauuugccgaa

SEQ ID NO: 5567 - DNA, 25 bp, Artificial Sequence
  Synthetic oligonucleotide
gcuaauuuagaugaauuugccgaag

SEQ ID NO: 5568 - DNA, 25 bp, Artificial Sequence
  Synthetic oligonucleotide
cuaauuuagaugaauuugccgaaga

SEQ ID NO: 5569 - DNA, 25 bp, Artificial Sequence
  Synthetic oligonucleotide
aucuuuuuaaauggaugcuaaaatt

SEQ ID NO: 5570 - DNA, 25 bp, Artificial Sequence
  Synthetic oligonucleotide
ucuuuuuaaauggaugcuaaaautc

SEQ ID NO: 5571 - DNA, 25 bp, Artificial Sequence
  Synthetic oligonucleotide
cuuuuuaaauggaugcuaaaauucc

SEQ ID NO: 5572 - DNA, 25 bp, Artificial Sequence
  Synthetic oligonucleotide
uuuuuaaauggaugcuaaaauucct

SEQ ID NO: 5573 - DNA, 25 bp, Artificial Sequence
  Synthetic oligonucleotide
uuuuaaauggaugcuaaaauucctg

SEQ ID NO: 5574 - DNA, 25 bp, Artificial Sequence
  Synthetic oligonucleotide
uuuaaauggaugcuaaaauuccuga

SEQ ID NO: 5575 - DNA, 25 bp, Artificial Sequence
  Synthetic oligonucleotide
uuaaauggaugcuaaaauuccugaa

SEQ ID NO: 5576 - DNA, 25 bp, Artificial Sequence
  Synthetic oligonucleotide
uaaauggaugcuaaaauuccugaag

SEQ ID NO: 5577 - DNA, 25 bp, Artificial Sequence
  Synthetic oligonucleotide
aaauggaugcuaaaauuccugaagt

SEQ ID NO: 5578 - DNA, 25 bp, Artificial Sequence
  Synthetic oligonucleotide
aauggaugcuaaaauuccugaagtt

SEQ ID NO: 5579 - DNA, 25 bp, Artificial Sequence
  Synthetic oligonucleotide
auggaugcuaaaauuccugaagutc

SEQ ID NO: 5580 - DNA, 25 bp, Artificial Sequence
  Synthetic oligonucleotide
ggaugcuaaaauuccugaaguucag

SEQ ID NO: 5581 - DNA, 25 bp, Artificial Sequence
  Synthetic oligonucleotide
gaugcuaaaauuccugaaguucagc

SEQ ID NO: 5582 - DNA, 25 bp, Artificial Sequence
  Synthetic oligonucleotide
augcuaaaauuccugaaguucagct

SEQ ID NO: 5583 - DNA, 25 bp, Artificial Sequence
  Synthetic oligonucleotide
ugcuaaaauuccugaaguucagctg

SEQ ID NO: 5584 - DNA, 25 bp, Artificial Sequence
  Synthetic oligonucleotide
gcuaaaauuccugaaguucagcugc

SEQ ID NO: 5585 - DNA, 25 bp, Artificial Sequence
  Synthetic oligonucleotide
cuaaaauuccugaaguucagcugca

SEQ ID NO: 5586 - DNA, 25 bp, Artificial Sequence
  Synthetic oligonucleotide
uaaaauuccugaaguucagcugcat

SEQ ID NO: 5587 - DNA, 25 bp, Artificial Sequence
  Synthetic oligonucleotide
aaaauuccugaaguucagcugcata

SEQ ID NO: 5588 - DNA, 25 bp, Artificial Sequence
  Synthetic oligonucleotide
aaauuccugaaguucagcugcauac

SEQ ID NO: 5589 - DNA, 25 bp, Artificial Sequence
  Synthetic oligonucleotide
aauuccugaaguucagcugcauaca

SEQ ID NO: 5590 - DNA, 25 bp, Artificial Sequence
  Synthetic oligonucleotide
auuccugaaguucagcugcauacag

SEQ ID NO: 5591 - DNA, 25 bp, Artificial Sequence
  Synthetic oligonucleotide
uuccugaaguucagcugcauacagt

SEQ ID NO: 5592 - DNA, 25 bp, Artificial Sequence
  Synthetic oligonucleotide
uccugaaguucagcugcauacagtt

SEQ ID NO: 5593 - DNA, 25 bp, Artificial Sequence
  Synthetic oligonucleotide
ccugaaguucagcugcauacagutt

SEQ ID NO: 5594 - DNA, 25 bp, Artificial Sequence
  Synthetic oligonucleotide
cugaaguucagcugcauacaguutg

SEQ ID NO: 5595 - DNA, 25 bp, Artificial Sequence
  Synthetic oligonucleotide
ugaaguucagcugcauacaguuugc

SEQ ID NO: 5596 - DNA, 25 bp, Artificial Sequence
  Synthetic oligonucleotide
gaaguucagcugcauacaguuugca

SEQ ID NO: 5597 - DNA, 25 bp, Artificial Sequence
  Synthetic oligonucleotide
aaguucagcugcauacaguuugcac

SEQ ID NO: 5598 - DNA, 25 bp, Artificial Sequence
  Synthetic oligonucleotide
aguucagcugcauacaguuugcact

SEQ ID NO: 5599 - DNA, 25 bp, Artificial Sequence
  Synthetic oligonucleotide
guucagcugcauacaguuugcactt

SEQ ID NO: 5600 - DNA, 25 bp, Artificial Sequence
  Synthetic oligonucleotide
uucagcugcauacaguuugcacuta

SEQ ID NO: 5601 - DNA, 25 bp, Artificial Sequence
  Synthetic oligonucleotide
ucagcugcauacaguuugcacuuat

SEQ ID NO: 5602 - DNA, 25 bp, Artificial Sequence
  Synthetic oligonucleotide
cagcugcauacaguuugcacuuatg

SEQ ID NO: 5603 - DNA, 25 bp, Artificial Sequence
  Synthetic oligonucleotide
agcugcauacaguuugcacuuaugg

SEQ ID NO: 5604 - DNA, 25 bp, Artificial Sequence
  Synthetic oligonucleotide
gcugcauacaguuugcacuuaugga

SEQ ID NO: 5605 - DNA, 25 bp, Artificial Sequence
  Synthetic oligonucleotide
cugcauacaguuugcacuuauggac

SEQ ID NO: 5606 - DNA, 25 bp, Artificial Sequence
  Synthetic oligonucleotide
ugcauacaguuugcacuuauggact

SEQ ID NO: 5607 - DNA, 25 bp, Artificial Sequence
  Synthetic oligonucleotide
gcauacaguuugcacuuauggactc

SEQ ID NO: 5608 - DNA, 25 bp, Artificial Sequence
  Synthetic oligonucleotide
cauacaguuugcacuuauggacucc

SEQ ID NO: 5609 - DNA, 25 bp, Artificial Sequence
  Synthetic oligonucleotide
auacaguuugcacuuauggacucct

SEQ ID NO: 5610 - DNA, 25 bp, Artificial Sequence
  Synthetic oligonucleotide
uacaguuugcacuuauggacucctg

SEQ ID NO: 5611 - DNA, 25 bp, Artificial Sequence
  Synthetic oligonucleotide
acaguuugcacuuauggacuccugt

SEQ ID NO: 5612 - DNA, 25 bp, Artificial Sequence
  Synthetic oligonucleotide
caguuugcacuuauggacuccugtt

SEQ ID NO: 5613 - DNA, 25 bp, Artificial Sequence
  Synthetic oligonucleotide
aguuugcacuuauggacuccugutg

SEQ ID NO: 5614 - DNA, 25 bp, Artificial Sequence
  Synthetic oligonucleotide
guuugcacuuauggacuccuguugt

SEQ ID NO: 5615 - DNA, 25 bp, Artificial Sequence
  Synthetic oligonucleotide
uuugcacuuauggacuccuguugtt

SEQ ID NO: 5616 - DNA, 25 bp, Artificial Sequence
  Synthetic oligonucleotide
uugcacuuauggacuccuguugutg

SEQ ID NO: 5617 - DNA, 25 bp, Artificial Sequence
  Synthetic oligonucleotide
ugcacuuauggacuccuguuguuga

SEQ ID NO: 5618 - DNA, 25 bp, Artificial Sequence
  Synthetic oligonucleotide
gcacuuauggacuccuguuguugaa

SEQ ID NO: 5619 - DNA, 25 bp, Artificial Sequence
  Synthetic oligonucleotide
cacuuauggacuccuguuguugaag

SEQ ID NO: 5620 - DNA, 25 bp, Artificial Sequence
  Synthetic oligonucleotide
acuuauggacuccuguuguugaagt

SEQ ID NO: 5621 - DNA, 25 bp, Artificial Sequence
  Synthetic oligonucleotide
cuuauggacuccuguuguugaagtt

SEQ ID NO: 5622 - DNA, 25 bp, Artificial Sequence
  Synthetic oligonucleotide
uuauggacuccuguuguugaagutc

SEQ ID NO: 5623 - DNA, 25 bp, Artificial Sequence
  Synthetic oligonucleotide
uauggacuccuguuguugaaguucg

SEQ ID NO: 5624 - DNA, 25 bp, Artificial Sequence
  Synthetic oligonucleotide
uggacuccuguuguugaaguucgtt

SEQ ID NO: 5625 - DNA, 25 bp, Artificial Sequence
  Synthetic oligonucleotide
agcuggucuuauuuguaaagcucac

SEQ ID NO: 5626 - DNA, 25 bp, Artificial Sequence
  Synthetic oligonucleotide
gcuggucuuauuuguaaagcucact

SEQ ID NO: 5627 - DNA, 25 bp, Artificial Sequence
  Synthetic oligonucleotide
cuggucuuauuuguaaagcucactt

SEQ ID NO: 5628 - DNA, 25 bp, Artificial Sequence
  Synthetic oligonucleotide
uggucuuauuuguaaagcucacutt

SEQ ID NO: 5629 - DNA, 25 bp, Artificial Sequence
  Synthetic oligonucleotide
ggucuuauuuguaaagcucacuuta

SEQ ID NO: 5630 - DNA, 25 bp, Artificial Sequence
  Synthetic oligonucleotide
gucuuauuuguaaagcucacuuuac

SEQ ID NO: 5631 - DNA, 25 bp, Artificial Sequence
  Synthetic oligonucleotide
ucuuauuuguaaagcucacuuuact

SEQ ID NO: 5632 - DNA, 25 bp, Artificial Sequence
  Synthetic oligonucleotide
cuuauuuguaaagcucacuuuactt

SEQ ID NO: 5633 - DNA, 25 bp, Artificial Sequence
  Synthetic oligonucleotide
uuauuuguaaagcucacuuuacuta

SEQ ID NO: 5634 - DNA, 25 bp, Artificial Sequence
  Synthetic oligonucleotide
uauuuguaaagcucacuuuacuuag

SEQ ID NO: 5635 - DNA, 25 bp, Artificial Sequence
  Synthetic oligonucleotide
auuuguaaagcucacuuuacuuaga

SEQ ID NO: 5636 - DNA, 25 bp, Artificial Sequence
  Synthetic oligonucleotide
uuuguaaagcucacuuuacuuagaa

SEQ ID NO: 5637 - DNA, 25 bp, Artificial Sequence
  Synthetic oligonucleotide
uuguaaagcucacuuuacuuagaat

SEQ ID NO: 5638 - DNA, 25 bp, Artificial Sequence
  Synthetic oligonucleotide
uguaaagcucacuuuacuuagaatt

SEQ ID NO: 5639 - DNA, 25 bp, Artificial Sequence
  Synthetic oligonucleotide
guaaagcucacuuuacuuagaauta

SEQ ID NO: 5640 - DNA, 25 bp, Artificial Sequence
  Synthetic oligonucleotide
uaaagcucacuuuacuuagaauuag

SEQ ID NO: 5641 - DNA, 25 bp, Artificial Sequence
  Synthetic oligonucleotide
aaagcucacuuuacuuagaauuagt

SEQ ID NO: 5642 - DNA, 25 bp, Artificial Sequence
  Synthetic oligonucleotide
aagcucacuuuacuuagaauuagtg

SEQ ID NO: 5643 - DNA, 25 bp, Artificial Sequence
  Synthetic oligonucleotide
agcucacuuuacuuagaauuagugg

SEQ ID NO: 5644 - DNA, 25 bp, Artificial Sequence
  Synthetic oligonucleotide
gcucacuuuacuuagaauuaguggc

SEQ ID NO: 5645 - DNA, 25 bp, Artificial Sequence
  Synthetic oligonucleotide
cucacuuuacuuagaauuaguggca

SEQ ID NO: 5646 - DNA, 25 bp, Artificial Sequence
  Synthetic oligonucleotide
ucacuuuacuuagaauuaguggcac

SEQ ID NO: 5647 - DNA, 25 bp, Artificial Sequence
  Synthetic oligonucleotide
cacuuuacuuagaauuaguggcact

SEQ ID NO: 5648 - DNA, 25 bp, Artificial Sequence
  Synthetic oligonucleotide
acuuuacuuagaauuaguggcactt

SEQ ID NO: 5649 - DNA, 25 bp, Artificial Sequence
  Synthetic oligonucleotide
cuuuacuuagaauuaguggcacutg

SEQ ID NO: 5650 - DNA, 25 bp, Artificial Sequence
  Synthetic oligonucleotide
uuuacuuagaauuaguggcacuugc

SEQ ID NO: 5651 - DNA, 25 bp, Artificial Sequence
  Synthetic oligonucleotide
uuacuuagaauuaguggcacuugct

SEQ ID NO: 5652 - DNA, 25 bp, Artificial Sequence
  Synthetic oligonucleotide
uacuuagaauuaguggcacuugctt

SEQ ID NO: 5653 - DNA, 25 bp, Artificial Sequence
  Synthetic oligonucleotide
acuuagaauuaguggcacuugcutt

SEQ ID NO: 5654 - DNA, 25 bp, Artificial Sequence
  Synthetic oligonucleotide
cuuagaauuaguggcacuugcuutt

SEQ ID NO: 5655 - DNA, 25 bp, Artificial Sequence
  Synthetic oligonucleotide
uuagaauuaguggcacuugcuuuta

SEQ ID NO: 5656 - DNA, 25 bp, Artificial Sequence
  Synthetic oligonucleotide
uagaauuaguggcacuugcuuuuat

SEQ ID NO: 5657 - DNA, 25 bp, Artificial Sequence
  Synthetic oligonucleotide
agaauuaguggcacuugcuuuuatt

SEQ ID NO: 5658 - DNA, 25 bp, Artificial Sequence
  Synthetic oligonucleotide
gaauuaguggcacuugcuuuuauta

SEQ ID NO: 5659 - DNA, 25 bp, Artificial Sequence
  Synthetic oligonucleotide
aauuaguggcacuugcuuuuauuag

SEQ ID NO: 5660 - DNA, 25 bp, Artificial Sequence
  Synthetic oligonucleotide
auuaguggcacuugcuuuuauuaga

SEQ ID NO: 5661 - DNA, 25 bp, Artificial Sequence
  Synthetic oligonucleotide
uuaguggcacuugcuuuuauuagag

SEQ ID NO: 5662 - DNA, 25 bp, Artificial Sequence
  Synthetic oligonucleotide
uaguggcacuugcuuuuauuagaga

SEQ ID NO: 5663 - DNA, 25 bp, Artificial Sequence
  Synthetic oligonucleotide
aguggcacuugcuuuuauuagagaa

SEQ ID NO: 5664 - DNA, 25 bp, Artificial Sequence
  Synthetic oligonucleotide
guggcacuugcuuuuauuagagaat

SEQ ID NO: 5665 - DNA, 25 bp, Artificial Sequence
  Synthetic oligonucleotide
uggcacuugcuuuuauuagagaatg

SEQ ID NO: 5666 - DNA, 25 bp, Artificial Sequence
  Synthetic oligonucleotide
ggcacuugcuuuuauuagagaauga

SEQ ID NO: 5667 - DNA, 25 bp, Artificial Sequence
  Synthetic oligonucleotide
gcacuugcuuuuauuagagaaugat

SEQ ID NO: 5668 - DNA, 25 bp, Artificial Sequence
  Synthetic oligonucleotide
cacuugcuuuuauuagagaaugatt

SEQ ID NO: 5669 - DNA, 25 bp, Artificial Sequence
  Synthetic oligonucleotide
acuugcuuuuauuagagaaugautt

SEQ ID NO: 5670 - DNA, 25 bp, Artificial Sequence
  Synthetic oligonucleotide
cuugcuuuuauuagagaaugauutc

SEQ ID NO: 5671 - DNA, 25 bp, Artificial Sequence
  Synthetic oligonucleotide
uuuuauuagagaaugauuucaaatg

SEQ ID NO: 5672 - DNA, 25 bp, Artificial Sequence
  Synthetic oligonucleotide
gcuguaacuuucugaaauaacaugg

SEQ ID NO: 5673 - DNA, 25 bp, Artificial Sequence
  Synthetic oligonucleotide
cuguaacuuucugaaauaacauggc

SEQ ID NO: 5674 - DNA, 25 bp, Artificial Sequence
  Synthetic oligonucleotide
uguaacuuucugaaauaacauggcc

SEQ ID NO: 5675 - DNA, 25 bp, Artificial Sequence
  Synthetic oligonucleotide
guaacuuucugaaauaacauggcct

SEQ ID NO: 5676 - DNA, 25 bp, Artificial Sequence
  Synthetic oligonucleotide
uaacuuucugaaauaacauggcctt

SEQ ID NO: 5677 - DNA, 25 bp, Artificial Sequence
  Synthetic oligonucleotide
aacuuucugaaauaacauggccutg

SEQ ID NO: 5678 - DNA, 25 bp, Artificial Sequence
  Synthetic oligonucleotide
acuuucugaaauaacauggccuugg

SEQ ID NO: 5679 - DNA, 25 bp, Artificial Sequence
  Synthetic oligonucleotide
cuuucugaaauaacauggccuugga

SEQ ID NO: 5680 - DNA, 25 bp, Artificial Sequence
  Synthetic oligonucleotide
uuucugaaauaacauggccuuggag

SEQ ID NO: 5681 - DNA, 25 bp, Artificial Sequence
  Synthetic oligonucleotide
uucugaaauaacauggccuuggagg

SEQ ID NO: 5682 - DNA, 25 bp, Artificial Sequence
  Synthetic oligonucleotide
ucugaaauaacauggccuuggaggg

SEQ ID NO: 5683 - DNA, 25 bp, Artificial Sequence
  Synthetic oligonucleotide
cugaaauaacauggccuuggagggc

SEQ ID NO: 5684 - DNA, 25 bp, Artificial Sequence
  Synthetic oligonucleotide
ugaaauaacauggccuuggagggca

SEQ ID NO: 5685 - DNA, 25 bp, Artificial Sequence
  Synthetic oligonucleotide
gaaauaacauggccuuggagggcat

SEQ ID NO: 5686 - DNA, 25 bp, Artificial Sequence
  Synthetic oligonucleotide
aaauaacauggccuuggagggcatg

SEQ ID NO: 5687 - DNA, 25 bp, Artificial Sequence
  Synthetic oligonucleotide
aauaacauggccuuggagggcauga

SEQ ID NO: 5688 - DNA, 25 bp, Artificial Sequence
  Synthetic oligonucleotide
auaacauggccuuggagggcaugaa

SEQ ID NO: 5689 - DNA, 25 bp, Artificial Sequence
  Synthetic oligonucleotide
uaacauggccuuggagggcaugaag

SEQ ID NO: 5690 - DNA, 25 bp, Artificial Sequence
  Synthetic oligonucleotide
aacauggccuuggagggcaugaaga

SEQ ID NO: 5691 - DNA, 25 bp, Artificial Sequence
  Synthetic oligonucleotide
acauggccuuggagggcaugaagac

SEQ ID NO: 5692 - DNA, 25 bp, Artificial Sequence
  Synthetic oligonucleotide
cauggccuuggagggcaugaagaca

SEQ ID NO: 5693 - DNA, 25 bp, Artificial Sequence
  Synthetic oligonucleotide
auggccuuggagggcaugaagacag

SEQ ID NO: 5694 - DNA, 25 bp, Artificial Sequence
  Synthetic oligonucleotide
uggccuuggagggcaugaagacaga

SEQ ID NO: 5695 - DNA, 25 bp, Artificial Sequence
  Synthetic oligonucleotide
ggccuuggagggcaugaagacagat

SEQ ID NO: 5696 - DNA, 25 bp, Artificial Sequence
  Synthetic oligonucleotide
gccuuggagggcaugaagacagata

SEQ ID NO: 5697 - DNA, 25 bp, Artificial Sequence
  Synthetic oligonucleotide
ccuuggagggcaugaagacagauac

SEQ ID NO: 5698 - DNA, 25 bp, Artificial Sequence
  Synthetic oligonucleotide
cuuggagggcaugaagacagauact

SEQ ID NO: 5699 - DNA, 25 bp, Artificial Sequence
  Synthetic oligonucleotide
uuggagggcaugaagacagauactc

SEQ ID NO: 5700 - DNA, 25 bp, Artificial Sequence
  Synthetic oligonucleotide
uggagggcaugaagacagauacucc

SEQ ID NO: 5701 - DNA, 25 bp, Artificial Sequence
  Synthetic oligonucleotide
ggagggcaugaagacagauacucct

SEQ ID NO: 5702 - DNA, 25 bp, Artificial Sequence
  Synthetic oligonucleotide
gagggcaugaagacagauacucctc

SEQ ID NO: 5703 - DNA, 25 bp, Artificial Sequence
  Synthetic oligonucleotide
agggcaugaagacagauacuccucc

SEQ ID NO: 5704 - DNA, 25 bp, Artificial Sequence
  Synthetic oligonucleotide
gggcaugaagacagauacuccucca

SEQ ID NO: 5705 - DNA, 25 bp, Artificial Sequence
  Synthetic oligonucleotide
ggcaugaagacagauacuccuccaa

SEQ ID NO: 5706 - DNA, 25 bp, Artificial Sequence
  Synthetic oligonucleotide
gcaugaagacagauacuccuccaag

SEQ ID NO: 5707 - DNA, 25 bp, Artificial Sequence
  Synthetic oligonucleotide
caugaagacagauacuccuccaagg

SEQ ID NO: 5708 - DNA, 25 bp, Artificial Sequence
  Synthetic oligonucleotide
augaagacagauacuccuccaaggt

SEQ ID NO: 5709 - DNA, 25 bp, Artificial Sequence
  Synthetic oligonucleotide
ugaagacagauacuccuccaaggtt

SEQ ID NO: 5710 - DNA, 25 bp, Artificial Sequence
  Synthetic oligonucleotide
gaagacagauacuccuccaagguta

SEQ ID NO: 5711 - DNA, 25 bp, Artificial Sequence
  Synthetic oligonucleotide
aagacagauacuccuccaagguuat

SEQ ID NO: 5712 - DNA, 25 bp, Artificial Sequence
  Synthetic oligonucleotide
agacagauacuccuccaagguuatt

SEQ ID NO: 5713 - DNA, 25 bp, Artificial Sequence
  Synthetic oligonucleotide
gacagauacuccuccaagguuautg

SEQ ID NO: 5714 - DNA, 25 bp, Artificial Sequence
  Synthetic oligonucleotide
acagauacuccuccaagguuauugg

SEQ ID NO: 5715 - DNA, 25 bp, Artificial Sequence
  Synthetic oligonucleotide
agauacuccuccaagguuauuggac

SEQ ID NO: 5716 - DNA, 25 bp, Artificial Sequence
  Synthetic oligonucleotide
gauacuccuccaagguuauuggaca

SEQ ID NO: 5717 - DNA, 25 bp, Artificial Sequence
  Synthetic oligonucleotide
auacuccuccaagguuauuggacac

SEQ ID NO: 5718 - DNA, 25 bp, Artificial Sequence
  Synthetic oligonucleotide
uacuccuccaagguuauuggacacc

SEQ ID NO: 5719 - DNA, 25 bp, Artificial Sequence
  Synthetic oligonucleotide
acuccuccaagguuauuggacaccg

SEQ ID NO: 5720 - DNA, 25 bp, Artificial Sequence
  Synthetic oligonucleotide
cuccuccaagguuauuggacaccgg

SEQ ID NO: 5721 - DNA, 25 bp, Artificial Sequence
  Synthetic oligonucleotide
uccuccaagguuauuggacaccgga

SEQ ID NO: 5722 - DNA, 25 bp, Artificial Sequence
  Synthetic oligonucleotide
ccuccaagguuauuggacaccggaa

SEQ ID NO: 5723 - DNA, 25 bp, Artificial Sequence
  Synthetic oligonucleotide
cuccaagguuauuggacaccggaaa

SEQ ID NO: 5724 - DNA, 25 bp, Artificial Sequence
  Synthetic oligonucleotide
uccaagguuauuggacaccggaaac

SEQ ID NO: 5725 - DNA, 25 bp, Artificial Sequence
  Synthetic oligonucleotide
ccaagguuauuggacaccggaaaca

SEQ ID NO: 5726 - DNA, 25 bp, Artificial Sequence
  Synthetic oligonucleotide
caagguuauuggacaccggaaacaa

SEQ ID NO: 5727 - DNA, 25 bp, Artificial Sequence
  Synthetic oligonucleotide
aagguuauuggacaccggaaacaat

SEQ ID NO: 5728 - DNA, 25 bp, Artificial Sequence
  Synthetic oligonucleotide
agguuauuggacaccggaaacaata

SEQ ID NO: 5729 - DNA, 25 bp, Artificial Sequence
  Synthetic oligonucleotide
gguuauuggacaccggaaacaauaa

SEQ ID NO: 5730 - DNA, 25 bp, Artificial Sequence
  Synthetic oligonucleotide
guuauuggacaccggaaacaauaaa

SEQ ID NO: 5731 - DNA, 25 bp, Artificial Sequence
  Synthetic oligonucleotide
uuauuggacaccggaaacaauaaat

SEQ ID NO: 5732 - DNA, 25 bp, Artificial Sequence
  Synthetic oligonucleotide
uauuggacaccggaaacaauaaatt

SEQ ID NO: 5733 - DNA, 25 bp, Artificial Sequence
  Synthetic oligonucleotide
auuggacaccggaaacaauaaautg

SEQ ID NO: 5734 - DNA, 25 bp, Artificial Sequence
  Synthetic oligonucleotide
uuggacaccggaaacaauaaauugg

SEQ ID NO: 5735 - DNA, 25 bp, Artificial Sequence
  Synthetic oligonucleotide
uggacaccggaaacaauaaauugga

SEQ ID NO: 5736 - DNA, 25 bp, Artificial Sequence
  Synthetic oligonucleotide
ggacaccggaaacaauaaauuggaa

SEQ ID NO: 5737 - DNA, 25 bp, Artificial Sequence
  Synthetic oligonucleotide
gacaccggaaacaauaaauuggaac

SEQ ID NO: 5738 - DNA, 25 bp, Artificial Sequence
  Synthetic oligonucleotide
acaccggaaacaauaaauuggaaca

SEQ ID NO: 5739 - DNA, 25 bp, Artificial Sequence
  Synthetic oligonucleotide
gaacaccuccucaaaccuaccactc

SEQ ID NO: 5740 - DNA, 25 bp, Artificial Sequence
  Synthetic oligonucleotide
aacaccuccucaaaccuaccacuca

SEQ ID NO: 5741 - DNA, 25 bp, Artificial Sequence
  Synthetic oligonucleotide
acaccuccucaaaccuaccacucag

SEQ ID NO: 5742 - DNA, 25 bp, Artificial Sequence
  Synthetic oligonucleotide
caccuccucaaaccuaccacucagg

SEQ ID NO: 5743 - DNA, 25 bp, Artificial Sequence
  Synthetic oligonucleotide
accuccucaaaccuaccacucagga

SEQ ID NO: 5744 - DNA, 25 bp, Artificial Sequence
  Synthetic oligonucleotide
ccuccucaaaccuaccacucaggaa

SEQ ID NO: 5745 - DNA, 25 bp, Artificial Sequence
  Synthetic oligonucleotide
gccgaaagaacaguccauugaaagg

SEQ ID NO: 5746 - DNA, 25 bp, Artificial Sequence
  Synthetic oligonucleotide
ccgaaagaacaguccauugaaaggg

SEQ ID NO: 5747 - DNA, 25 bp, Artificial Sequence
  Synthetic oligonucleotide
cgaaagaacaguccauugaaaggga

SEQ ID NO: 5748 - DNA, 25 bp, Artificial Sequence
  Synthetic oligonucleotide
gaaagaacaguccauugaaagggag

SEQ ID NO: 5749 - DNA, 25 bp, Artificial Sequence
  Synthetic oligonucleotide
aaagaacaguccauugaaagggagt

SEQ ID NO: 5750 - DNA, 25 bp, Artificial Sequence
  Synthetic oligonucleotide
ggaguauuacaaaaacauggccutt

SEQ ID NO: 5751 - DNA, 25 bp, Artificial Sequence
  Synthetic oligonucleotide
gaguauuacaaaaacauggccuutg

SEQ ID NO: 5752 - DNA, 25 bp, Artificial Sequence
  Synthetic oligonucleotide
aguauuacaaaaacauggccuuugc

SEQ ID NO: 5753 - DNA, 25 bp, Artificial Sequence
  Synthetic oligonucleotide
guauuacaaaaacauggccuuugct

SEQ ID NO: 5754 - DNA, 25 bp, Artificial Sequence
  Synthetic oligonucleotide
uauuacaaaaacauggccuuugctt

SEQ ID NO: 5755 - DNA, 25 bp, Artificial Sequence
  Synthetic oligonucleotide
auuacaaaaacauggccuuugcutg

SEQ ID NO: 5756 - DNA, 25 bp, Artificial Sequence
  Synthetic oligonucleotide
uuacaaaaacauggccuuugcuuga

SEQ ID NO: 5757 - DNA, 25 bp, Artificial Sequence
  Synthetic oligonucleotide
uacaaaaacauggccuuugcuugaa

SEQ ID NO: 5758 - DNA, 25 bp, Artificial Sequence
  Synthetic oligonucleotide
acaaaaacauggccuuugcuugaaa

SEQ ID NO: 5759 - DNA, 25 bp, Artificial Sequence
  Synthetic oligonucleotide
caaaaacauggccuuugcuugaaag

SEQ ID NO: 5760 - DNA, 25 bp, Artificial Sequence
  Synthetic oligonucleotide
aaaaacauggccuuugcuugaaaga

SEQ ID NO: 5761 - DNA, 25 bp, Artificial Sequence
  Synthetic oligonucleotide
aaaacauggccuuugcuugaaagaa

SEQ ID NO: 5762 - DNA, 25 bp, Artificial Sequence
  Synthetic oligonucleotide
aaacauggccuuugcuugaaagaaa

SEQ ID NO: 5763 - DNA, 25 bp, Artificial Sequence
  Synthetic oligonucleotide
aacauggccuuugcuugaaagaaaa

SEQ ID NO: 5764 - DNA, 25 bp, Artificial Sequence
  Synthetic oligonucleotide
acauggccuuugcuugaaagaaaat

SEQ ID NO: 5765 - DNA, 25 bp, Artificial Sequence
  Synthetic oligonucleotide
cauggccuuugcuugaaagaaaata

SEQ ID NO: 5766 - DNA, 25 bp, Artificial Sequence
  Synthetic oligonucleotide
auggccuuugcuugaaagaaaauac

SEQ ID NO: 5767 - DNA, 25 bp, Artificial Sequence
  Synthetic oligonucleotide
uggccuuugcuugaaagaaaauacc

SEQ ID NO: 5768 - DNA, 25 bp, Artificial Sequence
  Synthetic oligonucleotide
ggccuuugcuugaaagaaaauacca

SEQ ID NO: 5769 - DNA, 25 bp, Artificial Sequence
  Synthetic oligonucleotide
gccuuugcuugaaagaaaauaccaa

SEQ ID NO: 5770 - DNA, 25 bp, Artificial Sequence
  Synthetic oligonucleotide
ccuuugcuugaaagaaaauaccaag

SEQ ID NO: 5771 - DNA, 25 bp, Artificial Sequence
  Synthetic oligonucleotide
cuuugcuugaaagaaaauaccaagg

SEQ ID NO: 5772 - DNA, 25 bp, Artificial Sequence
  Synthetic oligonucleotide
uuugcuugaaagaaaauaccaagga

SEQ ID NO: 5773 - DNA, 25 bp, Artificial Sequence
  Synthetic oligonucleotide
uugcuugaaagaaaauaccaaggaa

SEQ ID NO: 5774 - DNA, 25 bp, Artificial Sequence
  Synthetic oligonucleotide
ugcuugaaagaaaauaccaaggaac

SEQ ID NO: 5775 - DNA, 25 bp, Artificial Sequence
  Synthetic oligonucleotide
acaggaaacugaucauuaaagcctg

SEQ ID NO: 5776 - DNA, 25 bp, Artificial Sequence
  Synthetic oligonucleotide
caggaaacugaucauuaaagccuga

SEQ ID NO: 5777 - DNA, 25 bp, Artificial Sequence
  Synthetic oligonucleotide
aggaaacugaucauuaaagccugag

SEQ ID NO: 5778 - DNA, 25 bp, Artificial Sequence
  Synthetic oligonucleotide
ggaaacugaucauuaaagccugagt

SEQ ID NO: 5779 - DNA, 25 bp, Artificial Sequence
  Synthetic oligonucleotide
gaaacugaucauuaaagccugagtt

SEQ ID NO: 5780 - DNA, 25 bp, Artificial Sequence
  Synthetic oligonucleotide
aaacugaucauuaaagccugagutt

SEQ ID NO: 5781 - DNA, 25 bp, Artificial Sequence
  Synthetic oligonucleotide
aacugaucauuaaagccugaguutg

SEQ ID NO: 5782 - DNA, 25 bp, Artificial Sequence
  Synthetic oligonucleotide
acugaucauuaaagccugaguuugc

SEQ ID NO: 5783 - DNA, 25 bp, Artificial Sequence
  Synthetic oligonucleotide
cugaucauuaaagccugaguuugct

SEQ ID NO: 5784 - DNA, 25 bp, Artificial Sequence
  Synthetic oligonucleotide
ugaucauuaaagccugaguuugctt

SEQ ID NO: 5785 - DNA, 25 bp, Artificial Sequence
  Synthetic oligonucleotide
gaucauuaaagccugaguuugcutt

SEQ ID NO: 5786 - DNA, 25 bp, Artificial Sequence
  Synthetic oligonucleotide
aucauuaaagccugaguuugcuutc

SEQ ID NO: 5787 - DNA, 25 bp, Artificial Sequence
  Synthetic oligonucleotide
ucauuaaagccugaguuugcuuuca

SEQ ID NO: 5788 - DNA, 25 bp, Artificial Sequence
  Synthetic oligonucleotide
uuaaagccugaguuugcuuucaaaa

SEQ ID NO: 5789 - DNA, 25 bp, Artificial Sequence
  Synthetic oligonucleotide
uaaagccugaguuugcuuucaaaaa

SEQ ID NO: 5790 - RNA, 27 nt, Artificial Sequence
  Synthetic oligonucleotide
aaaggcccaugguuggagguagcagga

SEQ ID NO: 5791 - RNA, 27 nt, Artificial Sequence
  Synthetic oligonucleotide
aaaaggcccaugguuggagguagcagg

SEQ ID NO: 5792 - RNA, 27 nt, Artificial Sequence
  Synthetic oligonucleotide
caaaaggcccaugguuggagguagcag

SEQ ID NO: 5793 - RNA, 27 nt, Artificial Sequence
  Synthetic oligonucleotide
ccaaaaggcccaugguuggagguagca

SEQ ID NO: 5794 - RNA, 27 nt, Artificial Sequence
  Synthetic oligonucleotide
uucccaaaaggcccaugguuggaggua

SEQ ID NO: 5795 - RNA, 27 nt, Artificial Sequence
  Synthetic oligonucleotide
auucccaaaaggcccaugguuggaggu

SEQ ID NO: 5796 - RNA, 27 nt, Artificial Sequence
  Synthetic oligonucleotide
uauucccaaaaggcccaugguuggagg

SEQ ID NO: 5797 - RNA, 27 nt, Artificial Sequence
  Synthetic oligonucleotide
guauucccaaaaggcccaugguuggag

SEQ ID NO: 5798 - RNA, 27 nt, Artificial Sequence
  Synthetic oligonucleotide
aguauucccaaaaggcccaugguugga

SEQ ID NO: 5799 - RNA, 27 nt, Artificial Sequence
  Synthetic oligonucleotide
aaguauucccaaaaggcccaugguugg

SEQ ID NO: 5800 - RNA, 27 nt, Artificial Sequence
  Synthetic oligonucleotide
aaaguauucccaaaaggcccaugguug

SEQ ID NO: 5801 - RNA, 27 nt, Artificial Sequence
  Synthetic oligonucleotide
caaaguauucccaaaaggcccaugguu

SEQ ID NO: 5802 - RNA, 27 nt, Artificial Sequence
  Synthetic oligonucleotide
acaaaguauucccaaaaggcccauggu

SEQ ID NO: 5803 - RNA, 27 nt, Artificial Sequence
  Synthetic oligonucleotide
aacaaaguauucccaaaaggcccaugg

SEQ ID NO: 5804 - RNA, 27 nt, Artificial Sequence
  Synthetic oligonucleotide
aaacaaaguauucccaaaaggcccaug

SEQ ID NO: 5805 - RNA, 27 nt, Artificial Sequence
  Synthetic oligonucleotide
aaaacaaaguauucccaaaaggcccau

SEQ ID NO: 5806 - RNA, 27 nt, Artificial Sequence
  Synthetic oligonucleotide
aaaaacaaaguauucccaaaaggccca

SEQ ID NO: 5807 - RNA, 27 nt, Artificial Sequence
  Synthetic oligonucleotide
aaaaaacaaaguauucccaaaaggccc

SEQ ID NO: 5808 - RNA, 27 nt, Artificial Sequence
  Synthetic oligonucleotide
uaaaaaacaaaguauucccaaaaggcc

SEQ ID NO: 5809 - RNA, 27 nt, Artificial Sequence
  Synthetic oligonucleotide
uuaaaaaacaaaguauucccaaaaggc

SEQ ID NO: 5810 - RNA, 27 nt, Artificial Sequence
  Synthetic oligonucleotide
auuaaaaaacaaaguauucccaaaagg

SEQ ID NO: 5811 - RNA, 27 nt, Artificial Sequence
  Synthetic oligonucleotide
gauuaaaaaacaaaguauucccaaaag

SEQ ID NO: 5812 - RNA, 27 nt, Artificial Sequence
  Synthetic oligonucleotide
agauuaaaaaacaaaguauucccaaaa

SEQ ID NO: 5813 - RNA, 27 nt, Artificial Sequence
  Synthetic oligonucleotide
aagauuaaaaaacaaaguauucccaaa

SEQ ID NO: 5814 - RNA, 27 nt, Artificial Sequence
  Synthetic oligonucleotide
gaagauuaaaaaacaaaguauucccaa

SEQ ID NO: 5815 - RNA, 27 nt, Artificial Sequence
  Synthetic oligonucleotide
ggaagauuaaaaaacaaaguauuccca

SEQ ID NO: 5816 - RNA, 27 nt, Artificial Sequence
  Synthetic oligonucleotide
aggaagauuaaaaaacaaaguauuccc

SEQ ID NO: 5817 - RNA, 27 nt, Artificial Sequence
  Synthetic oligonucleotide
caggaagauuaaaaaacaaaguauucc

SEQ ID NO: 5818 - RNA, 27 nt, Artificial Sequence
  Synthetic oligonucleotide
ccaggaagauuaaaaaacaaaguauuc

SEQ ID NO: 5819 - RNA, 27 nt, Artificial Sequence
  Synthetic oligonucleotide
cccaggaagauuaaaaaacaaaguauu

SEQ ID NO: 5820 - RNA, 27 nt, Artificial Sequence
  Synthetic oligonucleotide
ccccaggaagauuaaaaaacaaaguau

SEQ ID NO: 5821 - RNA, 27 nt, Artificial Sequence
  Synthetic oligonucleotide
uccccaggaagauuaaaaaacaaagua

SEQ ID NO: 5822 - RNA, 27 nt, Artificial Sequence
  Synthetic oligonucleotide
uuccccaggaagauuaaaaaacaaagu

SEQ ID NO: 5823 - RNA, 27 nt, Artificial Sequence
  Synthetic oligonucleotide
uuuccccaggaagauuaaaaaacaaag

SEQ ID NO: 5824 - RNA, 27 nt, Artificial Sequence
  Synthetic oligonucleotide
uuuuccccaggaagauuaaaaaacaaa

SEQ ID NO: 5825 - RNA, 27 nt, Artificial Sequence
  Synthetic oligonucleotide
guuuuccccaggaagauuaaaaaacaa

SEQ ID NO: 5826 - RNA, 27 nt, Artificial Sequence
  Synthetic oligonucleotide
ugacauauguuugcuccuguccccagg

SEQ ID NO: 5827 - RNA, 27 nt, Artificial Sequence
  Synthetic oligonucleotide
augacauauguuugcuccuguccccag

SEQ ID NO: 5828 - RNA, 27 nt, Artificial Sequence
  Synthetic oligonucleotide
aaugacauauguuugcuccugucccca

SEQ ID NO: 5829 - RNA, 27 nt, Artificial Sequence
  Synthetic oligonucleotide
aaaugacauauguuugcuccugucccc

SEQ ID NO: 5830 - RNA, 27 nt, Artificial Sequence
  Synthetic oligonucleotide
gaaaugacauauguuugcuccuguccc

SEQ ID NO: 5831 - RNA, 27 nt, Artificial Sequence
  Synthetic oligonucleotide
ugaaaugacauauguuugcuccugucc

SEQ ID NO: 5832 - RNA, 27 nt, Artificial Sequence
  Synthetic oligonucleotide
cugaaaugacauauguuugcuccuguc

SEQ ID NO: 5833 - RNA, 27 nt, Artificial Sequence
  Synthetic oligonucleotide
gcugaaaugacauauguuugcuccugu

SEQ ID NO: 5834 - RNA, 27 nt, Artificial Sequence
  Synthetic oligonucleotide
ugcugaaaugacauauguuugcuccug

SEQ ID NO: 5835 - RNA, 27 nt, Artificial Sequence
  Synthetic oligonucleotide
gugcugaaaugacauauguuugcuccu

SEQ ID NO: 5836 - RNA, 27 nt, Artificial Sequence
  Synthetic oligonucleotide
ggugcugaaaugacauauguuugcucc

SEQ ID NO: 5837 - RNA, 27 nt, Artificial Sequence
  Synthetic oligonucleotide
uggugcugaaaugacauauguuugcuc

SEQ ID NO: 5838 - RNA, 27 nt, Artificial Sequence
  Synthetic oligonucleotide
uuggugcugaaaugacauauguuugcu

SEQ ID NO: 5839 - RNA, 27 nt, Artificial Sequence
  Synthetic oligonucleotide
uuuggugcugaaaugacauauguuugc

SEQ ID NO: 5840 - RNA, 27 nt, Artificial Sequence
  Synthetic oligonucleotide
uuuuggugcugaaaugacauauguuug

SEQ ID NO: 5841 - RNA, 27 nt, Artificial Sequence
  Synthetic oligonucleotide
uuuuuggugcugaaaugacauauguuu

SEQ ID NO: 5842 - RNA, 27 nt, Artificial Sequence
  Synthetic oligonucleotide
auuuuuggugcugaaaugacauauguu

SEQ ID NO: 5843 - RNA, 27 nt, Artificial Sequence
  Synthetic oligonucleotide
auauuuuuggugcugaaaugacauaug

SEQ ID NO: 5844 - RNA, 27 nt, Artificial Sequence
  Synthetic oligonucleotide
aauauuuuuggugcugaaaugacauau

SEQ ID NO: 5845 - RNA, 27 nt, Artificial Sequence
  Synthetic oligonucleotide
gaauauuuuuggugcugaaaugacaua

SEQ ID NO: 5846 - RNA, 27 nt, Artificial Sequence
  Synthetic oligonucleotide
ggaauauuuuuggugcugaaaugacau

SEQ ID NO: 5847 - RNA, 27 nt, Artificial Sequence
  Synthetic oligonucleotide
cggaauauuuuuggugcugaaaugaca

SEQ ID NO: 5848 - RNA, 27 nt, Artificial Sequence
  Synthetic oligonucleotide
acggaauauuuuuggugcugaaaugac

SEQ ID NO: 5849 - RNA, 27 nt, Artificial Sequence
  Synthetic oligonucleotide
cacggaauauuuuuggugcugaaauga

SEQ ID NO: 5850 - RNA, 27 nt, Artificial Sequence
  Synthetic oligonucleotide
acacggaauauuuuuggugcugaaaug

SEQ ID NO: 5851 - RNA, 27 nt, Artificial Sequence
  Synthetic oligonucleotide
aacacggaauauuuuuggugcugaaau

SEQ ID NO: 5852 - RNA, 27 nt, Artificial Sequence
  Synthetic oligonucleotide
caacacggaauauuuuuggugcugaaa

SEQ ID NO: 5853 - RNA, 27 nt, Artificial Sequence
  Synthetic oligonucleotide
ccaacacggaauauuuuuggugcugaa

SEQ ID NO: 5854 - RNA, 27 nt, Artificial Sequence
  Synthetic oligonucleotide
uccaacacggaauauuuuuggugcuga

SEQ ID NO: 5855 - RNA, 27 nt, Artificial Sequence
  Synthetic oligonucleotide
cuccaacacggaauauuuuuggugcug

SEQ ID NO: 5856 - RNA, 27 nt, Artificial Sequence
  Synthetic oligonucleotide
gcuccaacacggaauauuuuuggugcu

SEQ ID NO: 5857 - RNA, 27 nt, Artificial Sequence
  Synthetic oligonucleotide
ugcuccaacacggaauauuuuuggugc

SEQ ID NO: 5858 - RNA, 27 nt, Artificial Sequence
  Synthetic oligonucleotide
augcuccaacacggaauauuuuuggug

SEQ ID NO: 5859 - RNA, 27 nt, Artificial Sequence
  Synthetic oligonucleotide
gaugcuccaacacggaauauuuuuggu

SEQ ID NO: 5860 - RNA, 27 nt, Artificial Sequence
  Synthetic oligonucleotide
agaugcuccaacacggaauauuuuugg

SEQ ID NO: 5861 - RNA, 27 nt, Artificial Sequence
  Synthetic oligonucleotide
cagaugcuccaacacggaauauuuuug

SEQ ID NO: 5862 - RNA, 27 nt, Artificial Sequence
  Synthetic oligonucleotide
ucagaugcuccaacacggaauauuuuu

SEQ ID NO: 5863 - RNA, 27 nt, Artificial Sequence
  Synthetic oligonucleotide
uucagaugcuccaacacggaauauuuu

SEQ ID NO: 5864 - RNA, 27 nt, Artificial Sequence
  Synthetic oligonucleotide
uuucagaugcuccaacacggaauauuu

SEQ ID NO: 5865 - RNA, 27 nt, Artificial Sequence
  Synthetic oligonucleotide
uuuucagaugcuccaacacggaauauu

SEQ ID NO: 5866 - RNA, 27 nt, Artificial Sequence
  Synthetic oligonucleotide
auuuucagaugcuccaacacggaauau

SEQ ID NO: 5867 - RNA, 27 nt, Artificial Sequence
  Synthetic oligonucleotide
uauuuucagaugcuccaacacggaaua

SEQ ID NO: 5868 - RNA, 27 nt, Artificial Sequence
  Synthetic oligonucleotide
auauuuucagaugcuccaacacggaau

SEQ ID NO: 5869 - RNA, 27 nt, Artificial Sequence
  Synthetic oligonucleotide
aauauuuucagaugcuccaacacggaa

SEQ ID NO: 5870 - RNA, 27 nt, Artificial Sequence
  Synthetic oligonucleotide
caauauuuucagaugcuccaacacgga

SEQ ID NO: 5871 - RNA, 27 nt, Artificial Sequence
  Synthetic oligonucleotide
acaauauuuucagaugcuccaacacgg

SEQ ID NO: 5872 - RNA, 27 nt, Artificial Sequence
  Synthetic oligonucleotide
caaaugcuucaguguauccauaaacuu

SEQ ID NO: 5873 - RNA, 27 nt, Artificial Sequence
  Synthetic oligonucleotide
caucaaaugcuucaguguauccauaaa

SEQ ID NO: 5874 - RNA, 27 nt, Artificial Sequence
  Synthetic oligonucleotide
ugcaucaaaugcuucaguguauccaua

SEQ ID NO: 5875 - RNA, 27 nt, Artificial Sequence
  Synthetic oligonucleotide
agagauuguugcaucaaaugcuucagu

SEQ ID NO: 5876 - RNA, 27 nt, Artificial Sequence
  Synthetic oligonucleotide
auagagauuguugcaucaaaugcuuca

SEQ ID NO: 5877 - RNA, 27 nt, Artificial Sequence
  Synthetic oligonucleotide
uaauagagauuguugcaucaaaugcuu

SEQ ID NO: 5878 - RNA, 27 nt, Artificial Sequence
  Synthetic oligonucleotide
uuuaauagagauuguugcaucaaaugc

SEQ ID NO: 5879 - RNA, 27 nt, Artificial Sequence
  Synthetic oligonucleotide
uuuuaauagagauuguugcaucaaaug

SEQ ID NO: 5880 - RNA, 27 nt, Artificial Sequence
  Synthetic oligonucleotide
cuuuuaauagagauuguugcaucaaau

SEQ ID NO: 5881 - RNA, 27 nt, Artificial Sequence
  Synthetic oligonucleotide
gauaacuuuuaauagagauuguugcau

SEQ ID NO: 5882 - RNA, 27 nt, Artificial Sequence
  Synthetic oligonucleotide
ggauaacuuuuaauagagauuguugca

SEQ ID NO: 5883 - RNA, 27 nt, Artificial Sequence
  Synthetic oligonucleotide
aggauaacuuuuaauagagauuguugc

SEQ ID NO: 5884 - RNA, 27 nt, Artificial Sequence
  Synthetic oligonucleotide
aucaggauaacuuuuaauagagauugu

SEQ ID NO: 5885 - RNA, 27 nt, Artificial Sequence
  Synthetic oligonucleotide
uaucaggauaacuuuuaauagagauug

SEQ ID NO: 5886 - RNA, 27 nt, Artificial Sequence
  Synthetic oligonucleotide
uuaucaggauaacuuuuaauagagauu

SEQ ID NO: 5887 - RNA, 27 nt, Artificial Sequence
  Synthetic oligonucleotide
uuuaucaggauaacuuuuaauagagau

SEQ ID NO: 5888 - RNA, 27 nt, Artificial Sequence
  Synthetic oligonucleotide
uuuuaucaggauaacuuuuaauagaga

SEQ ID NO: 5889 - RNA, 27 nt, Artificial Sequence
  Synthetic oligonucleotide
uuuuuuaucaggauaacuuuuaauaga

SEQ ID NO: 5890 - RNA, 27 nt, Artificial Sequence
  Synthetic oligonucleotide
aauuuuuuaucaggauaacuuuuaaua

SEQ ID NO: 5891 - RNA, 27 nt, Artificial Sequence
  Synthetic oligonucleotide
aaauuuuuuaucaggauaacuuuuaau

SEQ ID NO: 5892 - RNA, 27 nt, Artificial Sequence
  Synthetic oligonucleotide
acuaaauuuuuuaucaggauaacuuuu

SEQ ID NO: 5893 - RNA, 27 nt, Artificial Sequence
  Synthetic oligonucleotide
aacuaaauuuuuuaucaggauaacuuu

SEQ ID NO: 5894 - RNA, 27 nt, Artificial Sequence
  Synthetic oligonucleotide
aguaacuaaauuuuuuaucaggauaac

SEQ ID NO: 5895 - RNA, 27 nt, Artificial Sequence
  Synthetic oligonucleotide
gaguaacuaaauuuuuuaucaggauaa

SEQ ID NO: 5896 - RNA, 27 nt, Artificial Sequence
  Synthetic oligonucleotide
ggaguaacuaaauuuuuuaucaggaua

SEQ ID NO: 5897 - RNA, 27 nt, Artificial Sequence
  Synthetic oligonucleotide
aggaguaacuaaauuuuuuaucaggau

SEQ ID NO: 5898 - RNA, 27 nt, Artificial Sequence
  Synthetic oligonucleotide
gaggaguaacuaaauuuuuuaucagga

SEQ ID NO: 5899 - RNA, 27 nt, Artificial Sequence
  Synthetic oligonucleotide
ugaggaguaacuaaauuuuuuaucagg

SEQ ID NO: 5900 - RNA, 27 nt, Artificial Sequence
  Synthetic oligonucleotide
cugaggaguaacuaaauuuuuuaucag

SEQ ID NO: 5901 - RNA, 27 nt, Artificial Sequence
  Synthetic oligonucleotide
ccugaggaguaacuaaauuuuuuauca

SEQ ID NO: 5902 - RNA, 27 nt, Artificial Sequence
  Synthetic oligonucleotide
gccugaggaguaacuaaauuuuuuauc

SEQ ID NO: 5903 - RNA, 27 nt, Artificial Sequence
  Synthetic oligonucleotide
ggccugaggaguaacuaaauuuuuuau

SEQ ID NO: 5904 - RNA, 27 nt, Artificial Sequence
  Synthetic oligonucleotide
uggccugaggaguaacuaaauuuuuua

SEQ ID NO: 5905 - RNA, 27 nt, Artificial Sequence
  Synthetic oligonucleotide
auggccugaggaguaacuaaauuuuuu

SEQ ID NO: 5906 - RNA, 27 nt, Artificial Sequence
  Synthetic oligonucleotide
cauggccugaggaguaacuaaauuuuu

SEQ ID NO: 5907 - RNA, 27 nt, Artificial Sequence
  Synthetic oligonucleotide
acauggccugaggaguaacuaaauuuu

SEQ ID NO: 5908 - RNA, 27 nt, Artificial Sequence
  Synthetic oligonucleotide
aacauggccugaggaguaacuaaauuu

SEQ ID NO: 5909 - RNA, 27 nt, Artificial Sequence
  Synthetic oligonucleotide
gaacauggccugaggaguaacuaaauu

SEQ ID NO: 5910 - RNA, 27 nt, Artificial Sequence
  Synthetic oligonucleotide
ugaacauggccugaggaguaacuaaau

SEQ ID NO: 5911 - RNA, 27 nt, Artificial Sequence
  Synthetic oligonucleotide
augaacauggccugaggaguaacuaaa

SEQ ID NO: 5912 - RNA, 27 nt, Artificial Sequence
  Synthetic oligonucleotide
aaugaacauggccugaggaguaacuaa

SEQ ID NO: 5913 - RNA, 27 nt, Artificial Sequence
  Synthetic oligonucleotide
aaaugaacauggccugaggaguaacua

SEQ ID NO: 5914 - RNA, 27 nt, Artificial Sequence
  Synthetic oligonucleotide
uaaaugaacauggccugaggaguaacu

SEQ ID NO: 5915 - RNA, 27 nt, Artificial Sequence
  Synthetic oligonucleotide
auaaaugaacauggccugaggaguaac

SEQ ID NO: 5916 - RNA, 27 nt, Artificial Sequence
  Synthetic oligonucleotide
gauaaaugaacauggccugaggaguaa

SEQ ID NO: 5917 - RNA, 27 nt, Artificial Sequence
  Synthetic oligonucleotide
ggauaaaugaacauggccugaggagua

SEQ ID NO: 5918 - RNA, 27 nt, Artificial Sequence
  Synthetic oligonucleotide
aggauaaaugaacauggccugaggagu

SEQ ID NO: 5919 - RNA, 27 nt, Artificial Sequence
  Synthetic oligonucleotide
gaggauaaaugaacauggccugaggag

SEQ ID NO: 5920 - RNA, 27 nt, Artificial Sequence
  Synthetic oligonucleotide
ugaggauaaaugaacauggccugagga

SEQ ID NO: 5921 - RNA, 27 nt, Artificial Sequence
  Synthetic oligonucleotide
cugaggauaaaugaacauggccugagg

SEQ ID NO: 5922 - RNA, 27 nt, Artificial Sequence
  Synthetic oligonucleotide
ucugaggauaaaugaacauggccugag

SEQ ID NO: 5923 - RNA, 27 nt, Artificial Sequence
  Synthetic oligonucleotide
cucugaggauaaaugaacauggccuga

SEQ ID NO: 5924 - RNA, 27 nt, Artificial Sequence
  Synthetic oligonucleotide
ucucugaggauaaaugaacauggccug

SEQ ID NO: 5925 - RNA, 27 nt, Artificial Sequence
  Synthetic oligonucleotide
uucucugaggauaaaugaacauggccu

SEQ ID NO: 5926 - RNA, 27 nt, Artificial Sequence
  Synthetic oligonucleotide
auucucugaggauaaaugaacauggcc

SEQ ID NO: 5927 - RNA, 27 nt, Artificial Sequence
  Synthetic oligonucleotide
uauucucugaggauaaaugaacauggc

SEQ ID NO: 5928 - RNA, 27 nt, Artificial Sequence
  Synthetic oligonucleotide
uuauucucugaggauaaaugaacaugg

SEQ ID NO: 5929 - RNA, 27 nt, Artificial Sequence
  Synthetic oligonucleotide
uuuauucucugaggauaaaugaacaug

SEQ ID NO: 5930 - RNA, 27 nt, Artificial Sequence
  Synthetic oligonucleotide
gaauuuauucucugaggauaaaugaac

SEQ ID NO: 5931 - RNA, 27 nt, Artificial Sequence
  Synthetic oligonucleotide
ggaauuuauucucugaggauaaaugaa

SEQ ID NO: 5932 - RNA, 27 nt, Artificial Sequence
  Synthetic oligonucleotide
uggaauuuauucucugaggauaaauga

SEQ ID NO: 5933 - RNA, 27 nt, Artificial Sequence
  Synthetic oligonucleotide
uuggaauuuauucucugaggauaaaug

SEQ ID NO: 5934 - RNA, 27 nt, Artificial Sequence
  Synthetic oligonucleotide
uuuggaauuuauucucugaggauaaau

SEQ ID NO: 5935 - RNA, 27 nt, Artificial Sequence
  Synthetic oligonucleotide
uuuuggaauuuauucucugaggauaaa

SEQ ID NO: 5936 - RNA, 27 nt, Artificial Sequence
  Synthetic oligonucleotide
guuuuggaauuuauucucugaggauaa

SEQ ID NO: 5937 - RNA, 27 nt, Artificial Sequence
  Synthetic oligonucleotide
aguuuuggaauuuauucucugaggaua

SEQ ID NO: 5938 - RNA, 27 nt, Artificial Sequence
  Synthetic oligonucleotide
gaguuuuggaauuuauucucugaggau

SEQ ID NO: 5939 - RNA, 27 nt, Artificial Sequence
  Synthetic oligonucleotide
agaguuuuggaauuuauucucugagga

SEQ ID NO: 5940 - RNA, 27 nt, Artificial Sequence
  Synthetic oligonucleotide
cagaguuuuggaauuuauucucugagg

SEQ ID NO: 5941 - RNA, 27 nt, Artificial Sequence
  Synthetic oligonucleotide
gcagaguuuuggaauuuauucucugag

SEQ ID NO: 5942 - RNA, 27 nt, Artificial Sequence
  Synthetic oligonucleotide
ugcagaguuuuggaauuuauucucuga

SEQ ID NO: 5943 - RNA, 27 nt, Artificial Sequence
  Synthetic oligonucleotide
uugcagaguuuuggaauuuauucucug

SEQ ID NO: 5944 - RNA, 27 nt, Artificial Sequence
  Synthetic oligonucleotide
auugcagaguuuuggaauuuauucucu

SEQ ID NO: 5945 - RNA, 27 nt, Artificial Sequence
  Synthetic oligonucleotide
aauuguuuugguuguauuguuaagauu

SEQ ID NO: 5946 - RNA, 27 nt, Artificial Sequence
  Synthetic oligonucleotide
caauuguuuugguuguauuguuaagau

SEQ ID NO: 5947 - RNA, 27 nt, Artificial Sequence
  Synthetic oligonucleotide
gcaauuguuuugguuguauuguuaaga

SEQ ID NO: 5948 - RNA, 27 nt, Artificial Sequence
  Synthetic oligonucleotide
ggcaauuguuuugguuguauuguuaag

SEQ ID NO: 5949 - RNA, 27 nt, Artificial Sequence
  Synthetic oligonucleotide
aggcaauuguuuugguuguauuguuaa

SEQ ID NO: 5950 - RNA, 27 nt, Artificial Sequence
  Synthetic oligonucleotide
caggcaauuguuuugguuguauuguua

SEQ ID NO: 5951 - RNA, 27 nt, Artificial Sequence
  Synthetic oligonucleotide
ccaggcaauuguuuugguuguauuguu

SEQ ID NO: 5952 - RNA, 27 nt, Artificial Sequence
  Synthetic oligonucleotide
aaaugcuuugauacaacuuccaaauac

SEQ ID NO: 5953 - RNA, 27 nt, Artificial Sequence
  Synthetic oligonucleotide
aaaaugcuuugauacaacuuccaaaua

SEQ ID NO: 5954 - RNA, 27 nt, Artificial Sequence
  Synthetic oligonucleotide
uuugauuuugaaaaaugcuuugauaca

SEQ ID NO: 5955 - RNA, 27 nt, Artificial Sequence
  Synthetic oligonucleotide
uuuugauuuugaaaaaugcuuugauac

SEQ ID NO: 5956 - RNA, 27 nt, Artificial Sequence
  Synthetic oligonucleotide
uuuuugauuuugaaaaaugcuuugaua

SEQ ID NO: 5957 - RNA, 27 nt, Artificial Sequence
  Synthetic oligonucleotide
cuuuuugauuuugaaaaaugcuuugau

SEQ ID NO: 5958 - RNA, 27 nt, Artificial Sequence
  Synthetic oligonucleotide
ucuuuuugauuuugaaaaaugcuuuga

SEQ ID NO: 5959 - RNA, 27 nt, Artificial Sequence
  Synthetic oligonucleotide
gaaauccauugucauagguuauuggca

SEQ ID NO: 5960 - RNA, 27 nt, Artificial Sequence
  Synthetic oligonucleotide
agaaauccauugucauagguuauuggc

SEQ ID NO: 5961 - RNA, 27 nt, Artificial Sequence
  Synthetic oligonucleotide
agagaaauccauugucauagguuauug

SEQ ID NO: 5962 - RNA, 27 nt, Artificial Sequence
  Synthetic oligonucleotide
aagagaaauccauugucauagguuauu

SEQ ID NO: 5963 - RNA, 27 nt, Artificial Sequence
  Synthetic oligonucleotide
gaagagaaauccauugucauagguuau

SEQ ID NO: 5964 - RNA, 27 nt, Artificial Sequence
  Synthetic oligonucleotide
ugaagagaaauccauugucauagguua

SEQ ID NO: 5965 - RNA, 27 nt, Artificial Sequence
  Synthetic oligonucleotide
augaagagaaauccauugucauagguu

SEQ ID NO: 5966 - RNA, 27 nt, Artificial Sequence
  Synthetic oligonucleotide
gaaugaagagaaauccauugucauagg

SEQ ID NO: 5967 - RNA, 27 nt, Artificial Sequence
  Synthetic oligonucleotide
ugaaugaagagaaauccauugucauag

SEQ ID NO: 5968 - RNA, 27 nt, Artificial Sequence
  Synthetic oligonucleotide
augaaugaagagaaauccauugucaua

SEQ ID NO: 5969 - RNA, 27 nt, Artificial Sequence
  Synthetic oligonucleotide
cuguaugaaugaagagaaauccauugu

SEQ ID NO: 5970 - RNA, 27 nt, Artificial Sequence
  Synthetic oligonucleotide
ugucuguaugaaugaagagaaauccau

SEQ ID NO: 5971 - RNA, 27 nt, Artificial Sequence
  Synthetic oligonucleotide
uuugucuguaugaaugaagagaaaucc

SEQ ID NO: 5972 - RNA, 27 nt, Artificial Sequence
  Synthetic oligonucleotide
guuugucuguaugaaugaagagaaauc

SEQ ID NO: 5973 - RNA, 27 nt, Artificial Sequence
  Synthetic oligonucleotide
gguuugucuguaugaaugaagagaaau

SEQ ID NO: 5974 - RNA, 27 nt, Artificial Sequence
  Synthetic oligonucleotide
agguuugucuguaugaaugaagagaaa

SEQ ID NO: 5975 - RNA, 27 nt, Artificial Sequence
  Synthetic oligonucleotide
cagguuugucuguaugaaugaagagaa

SEQ ID NO: 5976 - RNA, 27 nt, Artificial Sequence
  Synthetic oligonucleotide
acagguuugucuguaugaaugaagaga

SEQ ID NO: 5977 - RNA, 27 nt, Artificial Sequence
  Synthetic oligonucleotide
aacagguuugucuguaugaaugaagag

SEQ ID NO: 5978 - RNA, 27 nt, Artificial Sequence
  Synthetic oligonucleotide
aaacagguuugucuguaugaaugaaga

SEQ ID NO: 5979 - RNA, 27 nt, Artificial Sequence
  Synthetic oligonucleotide
uaaacagguuugucuguaugaaugaag

SEQ ID NO: 5980 - RNA, 27 nt, Artificial Sequence
  Synthetic oligonucleotide
auaaacagguuugucuguaugaaugaa

SEQ ID NO: 5981 - RNA, 27 nt, Artificial Sequence
  Synthetic oligonucleotide
guauaaacagguuugucuguaugaaug

SEQ ID NO: 5982 - RNA, 27 nt, Artificial Sequence
  Synthetic oligonucleotide
uggaguauaaacagguuugucuguaug

SEQ ID NO: 5983 - RNA, 27 nt, Artificial Sequence
  Synthetic oligonucleotide
cuggaguauaaacagguuugucuguau

SEQ ID NO: 5984 - RNA, 27 nt, Artificial Sequence
  Synthetic oligonucleotide
ucuggaguauaaacagguuugucugua

SEQ ID NO: 5985 - RNA, 27 nt, Artificial Sequence
  Synthetic oligonucleotide
gucuggaguauaaacagguuugucugu

SEQ ID NO: 5986 - RNA, 27 nt, Artificial Sequence
  Synthetic oligonucleotide
ggucuggaguauaaacagguuugucug

SEQ ID NO: 5987 - RNA, 27 nt, Artificial Sequence
  Synthetic oligonucleotide
uggucuggaguauaaacagguuugucu

SEQ ID NO: 5988 - RNA, 27 nt, Artificial Sequence
  Synthetic oligonucleotide
cuggucuggaguauaaacagguuuguc

SEQ ID NO: 5989 - RNA, 27 nt, Artificial Sequence
  Synthetic oligonucleotide
acuggucuggaguauaaacagguuugu

SEQ ID NO: 5990 - RNA, 27 nt, Artificial Sequence
  Synthetic oligonucleotide
gacuggucuggaguauaaacagguuug

SEQ ID NO: 5991 - RNA, 27 nt, Artificial Sequence
  Synthetic oligonucleotide
ugacuggucuggaguauaaacagguuu

SEQ ID NO: 5992 - RNA, 27 nt, Artificial Sequence
  Synthetic oligonucleotide
cugacuggucuggaguauaaacagguu

SEQ ID NO: 5993 - RNA, 27 nt, Artificial Sequence
  Synthetic oligonucleotide
acugacuggucuggaguauaaacaggu

SEQ ID NO: 5994 - RNA, 27 nt, Artificial Sequence
  Synthetic oligonucleotide
ucgucauucaacgaauaaacucuaacu

SEQ ID NO: 5995 - RNA, 27 nt, Artificial Sequence
  Synthetic oligonucleotide
gucgucauucaacgaauaaacucuaac

SEQ ID NO: 5996 - RNA, 27 nt, Artificial Sequence
  Synthetic oligonucleotide
agucgucauucaacgaauaaacucuaa

SEQ ID NO: 5997 - RNA, 27 nt, Artificial Sequence
  Synthetic oligonucleotide
aagucgucauucaacgaauaaacucua

SEQ ID NO: 5998 - RNA, 27 nt, Artificial Sequence
  Synthetic oligonucleotide
uuucucuuuuggcuggcuucaagucgu

SEQ ID NO: 5999 - RNA, 27 nt, Artificial Sequence
  Synthetic oligonucleotide
guuucucuuuuggcuggcuucaagucg

SEQ ID NO: 6000 - RNA, 27 nt, Artificial Sequence
  Synthetic oligonucleotide
aguuucucuuuuggcuggcuucaaguc

SEQ ID NO: 6001 - RNA, 27 nt, Artificial Sequence
  Synthetic oligonucleotide
caguuucucuuuuggcuggcuucaagu

SEQ ID NO: 6002 - RNA, 27 nt, Artificial Sequence
  Synthetic oligonucleotide
acaguuucucuuuuggcuggcuucaag

SEQ ID NO: 6003 - RNA, 27 nt, Artificial Sequence
  Synthetic oligonucleotide
gacaguuucucuuuuggcuggcuucaa

SEQ ID NO: 6004 - RNA, 27 nt, Artificial Sequence
  Synthetic oligonucleotide
agacaguuucucuuuuggcuggcuuca

SEQ ID NO: 6005 - RNA, 27 nt, Artificial Sequence
  Synthetic oligonucleotide
aagacaguuucucuuuuggcuggcuuc

SEQ ID NO: 6006 - RNA, 27 nt, Artificial Sequence
  Synthetic oligonucleotide
uaagacaguuucucuuuuggcuggcuu

SEQ ID NO: 6007 - RNA, 27 nt, Artificial Sequence
  Synthetic oligonucleotide
uuaagacaguuucucuuuuggcuggcu

SEQ ID NO: 6008 - RNA, 27 nt, Artificial Sequence
  Synthetic oligonucleotide
guuaagacaguuucucuuuuggcuggc

SEQ ID NO: 6009 - RNA, 27 nt, Artificial Sequence
  Synthetic oligonucleotide
aguuaagacaguuucucuuuuggcugg

SEQ ID NO: 6010 - RNA, 27 nt, Artificial Sequence
  Synthetic oligonucleotide
aaguuaagacaguuucucuuuuggcug

SEQ ID NO: 6011 - RNA, 27 nt, Artificial Sequence
  Synthetic oligonucleotide
aaaguuaagacaguuucucuuuuggcu

SEQ ID NO: 6012 - RNA, 27 nt, Artificial Sequence
  Synthetic oligonucleotide
gaaaguuaagacaguuucucuuuuggc

SEQ ID NO: 6013 - RNA, 27 nt, Artificial Sequence
  Synthetic oligonucleotide
ugaaaguuaagacaguuucucuuuugg

SEQ ID NO: 6014 - RNA, 27 nt, Artificial Sequence
  Synthetic oligonucleotide
augaaaguuaagacaguuucucuuuug

SEQ ID NO: 6015 - RNA, 27 nt, Artificial Sequence
  Synthetic oligonucleotide
uaugaaaguuaagacaguuucucuuuu

SEQ ID NO: 6016 - RNA, 27 nt, Artificial Sequence
  Synthetic oligonucleotide
cuaugaaaguuaagacaguuucucuuu

SEQ ID NO: 6017 - RNA, 27 nt, Artificial Sequence
  Synthetic oligonucleotide
ucuaugaaaguuaagacaguuucucuu

SEQ ID NO: 6018 - RNA, 27 nt, Artificial Sequence
  Synthetic oligonucleotide
gaucuaugaaaguuaagacaguuucuc

SEQ ID NO: 6019 - RNA, 27 nt, Artificial Sequence
  Synthetic oligonucleotide
ggaucuaugaaaguuaagacaguuucu

SEQ ID NO: 6020 - RNA, 27 nt, Artificial Sequence
  Synthetic oligonucleotide
aggaucuaugaaaguuaagacaguuuc

SEQ ID NO: 6021 - RNA, 27 nt, Artificial Sequence
  Synthetic oligonucleotide
uucaggaucuaugaaaguuaagacagu

SEQ ID NO: 6022 - RNA, 27 nt, Artificial Sequence
  Synthetic oligonucleotide
cuucaggaucuaugaaaguuaagacag

SEQ ID NO: 6023 - RNA, 27 nt, Artificial Sequence
  Synthetic oligonucleotide
ccuucaggaucuaugaaaguuaagaca

SEQ ID NO: 6024 - RNA, 27 nt, Artificial Sequence
  Synthetic oligonucleotide
uccuucaggaucuaugaaaguuaagac

SEQ ID NO: 6025 - RNA, 27 nt, Artificial Sequence
  Synthetic oligonucleotide
auccuucaggaucuaugaaaguuaaga

SEQ ID NO: 6026 - RNA, 27 nt, Artificial Sequence
  Synthetic oligonucleotide
gauccuucaggaucuaugaaaguuaag

SEQ ID NO: 6027 - RNA, 27 nt, Artificial Sequence
  Synthetic oligonucleotide
ugauccuucaggaucuaugaaaguuaa

SEQ ID NO: 6028 - RNA, 27 nt, Artificial Sequence
  Synthetic oligonucleotide
cugauccuucaggaucuaugaaaguua

SEQ ID NO: 6029 - RNA, 27 nt, Artificial Sequence
  Synthetic oligonucleotide
ucugauccuucaggaucuaugaaaguu

SEQ ID NO: 6030 - RNA, 27 nt, Artificial Sequence
  Synthetic oligonucleotide
uucugauccuucaggaucuaugaaagu

SEQ ID NO: 6031 - RNA, 27 nt, Artificial Sequence
  Synthetic oligonucleotide
cuucugauccuucaggaucuaugaaag

SEQ ID NO: 6032 - RNA, 27 nt, Artificial Sequence
  Synthetic oligonucleotide
acuucugauccuucaggaucuaugaaa

SEQ ID NO: 6033 - RNA, 27 nt, Artificial Sequence
  Synthetic oligonucleotide
aacuucugauccuucaggaucuaugaa

SEQ ID NO: 6034 - RNA, 27 nt, Artificial Sequence
  Synthetic oligonucleotide
caacuucugauccuucaggaucuauga

SEQ ID NO: 6035 - RNA, 27 nt, Artificial Sequence
  Synthetic oligonucleotide
ucaacuucugauccuucaggaucuaug

SEQ ID NO: 6036 - RNA, 27 nt, Artificial Sequence
  Synthetic oligonucleotide
gucaacuucugauccuucaggaucuau

SEQ ID NO: 6037 - RNA, 27 nt, Artificial Sequence
  Synthetic oligonucleotide
ugaucaauuucuucuaccaugucaacu

SEQ ID NO: 6038 - RNA, 27 nt, Artificial Sequence
  Synthetic oligonucleotide
augaucaauuucuucuaccaugucaac

SEQ ID NO: 6039 - RNA, 27 nt, Artificial Sequence
  Synthetic oligonucleotide
aauaugaucaauuucuucuaccauguc

SEQ ID NO: 6040 - RNA, 27 nt, Artificial Sequence
  Synthetic oligonucleotide
caauaugaucaauuucuucuaccaugu

SEQ ID NO: 6041 - RNA, 27 nt, Artificial Sequence
  Synthetic oligonucleotide
ccaauaugaucaauuucuucuaccaug

SEQ ID NO: 6042 - RNA, 27 nt, Artificial Sequence
  Synthetic oligonucleotide
auuccaauaugaucaauuucuucuacc

SEQ ID NO: 6043 - RNA, 27 nt, Artificial Sequence
  Synthetic oligonucleotide
aauuccaauaugaucaauuucuucuac

SEQ ID NO: 6044 - RNA, 27 nt, Artificial Sequence
  Synthetic oligonucleotide
uaauuccaauaugaucaauuucuucua

SEQ ID NO: 6045 - RNA, 27 nt, Artificial Sequence
  Synthetic oligonucleotide
agauaauuccaauaugaucaauuucuu

SEQ ID NO: 6046 - RNA, 27 nt, Artificial Sequence
  Synthetic oligonucleotide
gagauaauuccaauaugaucaauuucu

SEQ ID NO: 6047 - RNA, 27 nt, Artificial Sequence
  Synthetic oligonucleotide
agagauaauuccaauaugaucaauuuc

SEQ ID NO: 6048 - RNA, 27 nt, Artificial Sequence
  Synthetic oligonucleotide
aagagauaauuccaauaugaucaauuu

SEQ ID NO: 6049 - RNA, 27 nt, Artificial Sequence
  Synthetic oligonucleotide
aaagagauaauuccaauaugaucaauu

SEQ ID NO: 6050 - RNA, 27 nt, Artificial Sequence
  Synthetic oligonucleotide
aaaagagauaauuccaauaugaucaau

SEQ ID NO: 6051 - RNA, 27 nt, Artificial Sequence
  Synthetic oligonucleotide
gaaaagagauaauuccaauaugaucaa

SEQ ID NO: 6052 - RNA, 27 nt, Artificial Sequence
  Synthetic oligonucleotide
ggaaaagagauaauuccaauaugauca

SEQ ID NO: 6053 - RNA, 27 nt, Artificial Sequence
  Synthetic oligonucleotide
aggaaaagagauaauuccaauaugauc

SEQ ID NO: 6054 - RNA, 27 nt, Artificial Sequence
  Synthetic oligonucleotide
caggaaaagagauaauuccaauaugau

SEQ ID NO: 6055 - RNA, 27 nt, Artificial Sequence
  Synthetic oligonucleotide
ucaggaaaagagauaauuccaauauga

SEQ ID NO: 6056 - RNA, 27 nt, Artificial Sequence
  Synthetic oligonucleotide
gucaggaaaagagauaauuccaauaug

SEQ ID NO: 6057 - RNA, 27 nt, Artificial Sequence
  Synthetic oligonucleotide
agucaggaaaagagauaauuccaauau

SEQ ID NO: 6058 - RNA, 27 nt, Artificial Sequence
  Synthetic oligonucleotide
aagucaggaaaagagauaauuccaaua

SEQ ID NO: 6059 - RNA, 27 nt, Artificial Sequence
  Synthetic oligonucleotide
gaagucaggaaaagagauaauuccaau

SEQ ID NO: 6060 - RNA, 27 nt, Artificial Sequence
  Synthetic oligonucleotide
auuagacggaaucuugaagucaggaaa

SEQ ID NO: 6061 - RNA, 27 nt, Artificial Sequence
  Synthetic oligonucleotide
gauuagacggaaucuugaagucaggaa

SEQ ID NO: 6062 - RNA, 27 nt, Artificial Sequence
  Synthetic oligonucleotide
ggauuagacggaaucuugaagucagga

SEQ ID NO: 6063 - RNA, 27 nt, Artificial Sequence
  Synthetic oligonucleotide
aggauuagacggaaucuugaagucagg

SEQ ID NO: 6064 - RNA, 27 nt, Artificial Sequence
  Synthetic oligonucleotide
uaggauuagacggaaucuugaagucag

SEQ ID NO: 6065 - RNA, 27 nt, Artificial Sequence
  Synthetic oligonucleotide
cuaggauuagacggaaucuugaaguca

SEQ ID NO: 6066 - RNA, 27 nt, Artificial Sequence
  Synthetic oligonucleotide
ucuaggauuagacggaaucuugaaguc

SEQ ID NO: 6067 - RNA, 27 nt, Artificial Sequence
  Synthetic oligonucleotide
aucuaggauuagacggaaucuugaagu

SEQ ID NO: 6068 - RNA, 27 nt, Artificial Sequence
  Synthetic oligonucleotide
uaucuaggauuagacggaaucuugaag

SEQ ID NO: 6069 - RNA, 27 nt, Artificial Sequence
  Synthetic oligonucleotide
auaucuaggauuagacggaaucuugaa

SEQ ID NO: 6070 - RNA, 27 nt, Artificial Sequence
  Synthetic oligonucleotide
cauaucuaggauuagacggaaucuuga

SEQ ID NO: 6071 - RNA, 27 nt, Artificial Sequence
  Synthetic oligonucleotide
ccauaucuaggauuagacggaaucuug

SEQ ID NO: 6072 - RNA, 27 nt, Artificial Sequence
  Synthetic oligonucleotide
accauaucuaggauuagacggaaucuu

SEQ ID NO: 6073 - RNA, 27 nt, Artificial Sequence
  Synthetic oligonucleotide
uaccauaucuaggauuagacggaaucu

SEQ ID NO: 6074 - RNA, 27 nt, Artificial Sequence
  Synthetic oligonucleotide
auaccauaucuaggauuagacggaauc

SEQ ID NO: 6075 - RNA, 27 nt, Artificial Sequence
  Synthetic oligonucleotide
cauaccauaucuaggauuagacggaau

SEQ ID NO: 6076 - RNA, 27 nt, Artificial Sequence
  Synthetic oligonucleotide
acauaccauaucuaggauuagacggaa

SEQ ID NO: 6077 - RNA, 27 nt, Artificial Sequence
  Synthetic oligonucleotide
cacauaccauaucuaggauuagacgga

SEQ ID NO: 6078 - RNA, 27 nt, Artificial Sequence
  Synthetic oligonucleotide
ccacauaccauaucuaggauuagacgg

SEQ ID NO: 6079 - RNA, 27 nt, Artificial Sequence
  Synthetic oligonucleotide
uccacauaccauaucuaggauuagacg

SEQ ID NO: 6080 - RNA, 27 nt, Artificial Sequence
  Synthetic oligonucleotide
guccacauaccauaucuaggauuagac

SEQ ID NO: 6081 - RNA, 27 nt, Artificial Sequence
  Synthetic oligonucleotide
cguccacauaccauaucuaggauuaga

SEQ ID NO: 6082 - RNA, 27 nt, Artificial Sequence
  Synthetic oligonucleotide
ucguccacauaccauaucuaggauuag

SEQ ID NO: 6083 - RNA, 27 nt, Artificial Sequence
  Synthetic oligonucleotide
aucguccacauaccauaucuaggauua

SEQ ID NO: 6084 - RNA, 27 nt, Artificial Sequence
  Synthetic oligonucleotide
gaucguccacauaccauaucuaggauu

SEQ ID NO: 6085 - RNA, 27 nt, Artificial Sequence
  Synthetic oligonucleotide
ugaucguccacauaccauaucuaggau

SEQ ID NO: 6086 - RNA, 27 nt, Artificial Sequence
  Synthetic oligonucleotide
gaaaaguccucuuuauauuuagccuug

SEQ ID NO: 6087 - RNA, 27 nt, Artificial Sequence
  Synthetic oligonucleotide
ugaaaaguccucuuuauauuuagccuu

SEQ ID NO: 6088 - RNA, 27 nt, Artificial Sequence
  Synthetic oligonucleotide
uugaaaaguccucuuuauauuuagccu

SEQ ID NO: 6089 - RNA, 27 nt, Artificial Sequence
  Synthetic oligonucleotide
guugaaaaguccucuuuauauuuagcc

SEQ ID NO: 6090 - RNA, 27 nt, Artificial Sequence
  Synthetic oligonucleotide
uguugaaaaguccucuuuauauuuagc

SEQ ID NO: 6091 - RNA, 27 nt, Artificial Sequence
  Synthetic oligonucleotide
uuguugaaaaguccucuuuauauuuag

SEQ ID NO: 6092 - RNA, 27 nt, Artificial Sequence
  Synthetic oligonucleotide
guuguugaaaaguccucuuuauauuua

SEQ ID NO: 6093 - RNA, 27 nt, Artificial Sequence
  Synthetic oligonucleotide
aguuguugaaaaguccucuuuauauuu

SEQ ID NO: 6094 - RNA, 27 nt, Artificial Sequence
  Synthetic oligonucleotide
caguuguugaaaaguccucuuuauauu

SEQ ID NO: 6095 - RNA, 27 nt, Artificial Sequence
  Synthetic oligonucleotide
ccaguuguugaaaaguccucuuuauau

SEQ ID NO: 6096 - RNA, 27 nt, Artificial Sequence
  Synthetic oligonucleotide
uccaguuguugaaaaguccucuuuaua

SEQ ID NO: 6097 - RNA, 27 nt, Artificial Sequence
  Synthetic oligonucleotide
uuccaguuguugaaaaguccucuuuau

SEQ ID NO: 6098 - RNA, 27 nt, Artificial Sequence
  Synthetic oligonucleotide
guuccaguuguugaaaaguccucuuua

SEQ ID NO: 6099 - RNA, 27 nt, Artificial Sequence
  Synthetic oligonucleotide
gguuccaguuguugaaaaguccucuuu

SEQ ID NO: 6100 - RNA, 27 nt, Artificial Sequence
  Synthetic oligonucleotide
cgguuccaguuguugaaaaguccucuu

SEQ ID NO: 6101 - RNA, 27 nt, Artificial Sequence
  Synthetic oligonucleotide
gcgguuccaguuguugaaaaguccucu

SEQ ID NO: 6102 - RNA, 27 nt, Artificial Sequence
  Synthetic oligonucleotide
ugcgguuccaguuguugaaaaguccuc

SEQ ID NO: 6103 - RNA, 27 nt, Artificial Sequence
  Synthetic oligonucleotide
augcgguuccaguuguugaaaaguccu

SEQ ID NO: 6104 - RNA, 27 nt, Artificial Sequence
  Synthetic oligonucleotide
uaugcgguuccaguuguugaaaagucc

SEQ ID NO: 6105 - RNA, 27 nt, Artificial Sequence
  Synthetic oligonucleotide
caagacauauucuuuaacuucaaaaua

SEQ ID NO: 6106 - RNA, 27 nt, Artificial Sequence
  Synthetic oligonucleotide
gcaagacauauucuuuaacuucaaaau

SEQ ID NO: 6107 - RNA, 27 nt, Artificial Sequence
  Synthetic oligonucleotide
ggcaagacauauucuuuaacuucaaaa

SEQ ID NO: 6108 - RNA, 27 nt, Artificial Sequence
  Synthetic oligonucleotide
uggcaagacauauucuuuaacuucaaa

SEQ ID NO: 6109 - RNA, 27 nt, Artificial Sequence
  Synthetic oligonucleotide
guggcaagacauauucuuuaacuucaa

SEQ ID NO: 6110 - RNA, 27 nt, Artificial Sequence
  Synthetic oligonucleotide
uguggcaagacauauucuuuaacuuca

SEQ ID NO: 6111 - RNA, 27 nt, Artificial Sequence
  Synthetic oligonucleotide
auguggcaagacauauucuuuaacuuc

SEQ ID NO: 6112 - RNA, 27 nt, Artificial Sequence
  Synthetic oligonucleotide
aauguggcaagacauauucuuuaacuu

SEQ ID NO: 6113 - RNA, 27 nt, Artificial Sequence
  Synthetic oligonucleotide
gaaaaauguggcaagacauauucuuua

SEQ ID NO: 6114 - RNA, 27 nt, Artificial Sequence
  Synthetic oligonucleotide
agaaaaauguggcaagacauauucuuu

SEQ ID NO: 6115 - RNA, 27 nt, Artificial Sequence
  Synthetic oligonucleotide
cagaaaaauguggcaagacauauucuu

SEQ ID NO: 6116 - RNA, 27 nt, Artificial Sequence
  Synthetic oligonucleotide
acagaaaaauguggcaagacauauucu

SEQ ID NO: 6117 - RNA, 27 nt, Artificial Sequence
  Synthetic oligonucleotide
gacagaaaaauguggcaagacauauuc

SEQ ID NO: 6118 - RNA, 27 nt, Artificial Sequence
  Synthetic oligonucleotide
agacagaaaaauguggcaagacauauu

SEQ ID NO: 6119 - RNA, 27 nt, Artificial Sequence
  Synthetic oligonucleotide
gagacagaaaaauguggcaagacauau

SEQ ID NO: 6120 - RNA, 27 nt, Artificial Sequence
  Synthetic oligonucleotide
ugagacagaaaaauguggcaagacaua

SEQ ID NO: 6121 - RNA, 27 nt, Artificial Sequence
  Synthetic oligonucleotide
uugagacagaaaaauguggcaagacau

SEQ ID NO: 6122 - RNA, 27 nt, Artificial Sequence
  Synthetic oligonucleotide
auugagacagaaaaauguggcaagaca

SEQ ID NO: 6123 - RNA, 27 nt, Artificial Sequence
  Synthetic oligonucleotide
gauugagacagaaaaauguggcaagac

SEQ ID NO: 6124 - RNA, 27 nt, Artificial Sequence
  Synthetic oligonucleotide
cgauugagacagaaaaauguggcaaga

SEQ ID NO: 6125 - RNA, 27 nt, Artificial Sequence
  Synthetic oligonucleotide
ucgauugagacagaaaaauguggcaag

SEQ ID NO: 6126 - RNA, 27 nt, Artificial Sequence
  Synthetic oligonucleotide
cucgauugagacagaaaaauguggcaa

SEQ ID NO: 6127 - RNA, 27 nt, Artificial Sequence
  Synthetic oligonucleotide
aguaauuucaaaauucuuaaaguucuu

SEQ ID NO: 6128 - RNA, 27 nt, Artificial Sequence
  Synthetic oligonucleotide
uaguaauuucaaaauucuuaaaguucu

SEQ ID NO: 6129 - RNA, 27 nt, Artificial Sequence
  Synthetic oligonucleotide
auaguaauuucaaaauucuuaaaguuc

SEQ ID NO: 6130 - RNA, 27 nt, Artificial Sequence
  Synthetic oligonucleotide
uuauaguaauuucaaaauucuuaaagu

SEQ ID NO: 6131 - RNA, 27 nt, Artificial Sequence
  Synthetic oligonucleotide
uuuauaguaauuucaaaauucuuaaag

SEQ ID NO: 6132 - RNA, 27 nt, Artificial Sequence
  Synthetic oligonucleotide
uuuuauaguaauuucaaaauucuuaaa

SEQ ID NO: 6133 - RNA, 27 nt, Artificial Sequence
  Synthetic oligonucleotide
cuuuuauaguaauuucaaaauucuuaa

SEQ ID NO: 6134 - RNA, 27 nt, Artificial Sequence
  Synthetic oligonucleotide
gcuuuuauaguaauuucaaaauucuua

SEQ ID NO: 6135 - RNA, 27 nt, Artificial Sequence
  Synthetic oligonucleotide
ucuugcuuuuauaguaauuucaaaauu

SEQ ID NO: 6136 - RNA, 27 nt, Artificial Sequence
  Synthetic oligonucleotide
aucuugcuuuuauaguaauuucaaaau

SEQ ID NO: 6137 - RNA, 27 nt, Artificial Sequence
  Synthetic oligonucleotide
aaauaucuugcuuuuauaguaauuuca

SEQ ID NO: 6138 - RNA, 27 nt, Artificial Sequence
  Synthetic oligonucleotide
aaaauaucuugcuuuuauaguaauuuc

SEQ ID NO: 6139 - RNA, 27 nt, Artificial Sequence
  Synthetic oligonucleotide
aaaaauaucuugcuuuuauaguaauuu

SEQ ID NO: 6140 - RNA, 27 nt, Artificial Sequence
  Synthetic oligonucleotide
uaaaaauaucuugcuuuuauaguaauu

SEQ ID NO: 6141 - RNA, 27 nt, Artificial Sequence
  Synthetic oligonucleotide
auaaaaauaucuugcuuuuauaguaau

SEQ ID NO: 6142 - RNA, 27 nt, Artificial Sequence
  Synthetic oligonucleotide
uauaaaaauaucuugcuuuuauaguaa

SEQ ID NO: 6143 - RNA, 27 nt, Artificial Sequence
  Synthetic oligonucleotide
uuauaaaaauaucuugcuuuuauagua

SEQ ID NO: 6144 - RNA, 27 nt, Artificial Sequence
  Synthetic oligonucleotide
auuauaaaaauaucuugcuuuuauagu

SEQ ID NO: 6145 - RNA, 27 nt, Artificial Sequence
  Synthetic oligonucleotide
uauuauaaaaauaucuugcuuuuauag

SEQ ID NO: 6146 - RNA, 27 nt, Artificial Sequence
  Synthetic oligonucleotide
uuauuauaaaaauaucuugcuuuuaua

SEQ ID NO: 6147 - RNA, 27 nt, Artificial Sequence
  Synthetic oligonucleotide
uuuauuauaaaaauaucuugcuuuuau

SEQ ID NO: 6148 - RNA, 27 nt, Artificial Sequence
  Synthetic oligonucleotide
agugacuacuuuauuauaaaaauaucu

SEQ ID NO: 6149 - RNA, 27 nt, Artificial Sequence
  Synthetic oligonucleotide
cagugacuacuuuauuauaaaaauauc

SEQ ID NO: 6150 - RNA, 27 nt, Artificial Sequence
  Synthetic oligonucleotide
ucagugacuacuuuauuauaaaaauau

SEQ ID NO: 6151 - RNA, 27 nt, Artificial Sequence
  Synthetic oligonucleotide
cucagugacuacuuuauuauaaaaaua

SEQ ID NO: 6152 - RNA, 27 nt, Artificial Sequence
  Synthetic oligonucleotide
ccucagugacuacuuuauuauaaaaau

SEQ ID NO: 6153 - RNA, 27 nt, Artificial Sequence
  Synthetic oligonucleotide
gccucagugacuacuuuauuauaaaaa

SEQ ID NO: 6154 - RNA, 27 nt, Artificial Sequence
  Synthetic oligonucleotide
agccucagugacuacuuuauuauaaaa

SEQ ID NO: 6155 - RNA, 27 nt, Artificial Sequence
  Synthetic oligonucleotide
cagccucagugacuacuuuauuauaaa

SEQ ID NO: 6156 - RNA, 27 nt, Artificial Sequence
  Synthetic oligonucleotide
ucagccucagugacuacuuuauuauaa

SEQ ID NO: 6157 - RNA, 27 nt, Artificial Sequence
  Synthetic oligonucleotide
gucagccucagugacuacuuuauuaua

SEQ ID NO: 6158 - RNA, 27 nt, Artificial Sequence
  Synthetic oligonucleotide
cgucagccucagugacuacuuuauuau

SEQ ID NO: 6159 - RNA, 27 nt, Artificial Sequence
  Synthetic oligonucleotide
acgucagccucagugacuacuuuauua

SEQ ID NO: 6160 - RNA, 27 nt, Artificial Sequence
  Synthetic oligonucleotide
aacgucagccucagugacuacuuuauu

SEQ ID NO: 6161 - RNA, 27 nt, Artificial Sequence
  Synthetic oligonucleotide
aaacgucagccucagugacuacuuuau

SEQ ID NO: 6162 - RNA, 27 nt, Artificial Sequence
  Synthetic oligonucleotide
uaaacgucagccucagugacuacuuua

SEQ ID NO: 6163 - RNA, 27 nt, Artificial Sequence
  Synthetic oligonucleotide
cucuuauuccaaaugugauauaaacgu

SEQ ID NO: 6164 - RNA, 27 nt, Artificial Sequence
  Synthetic oligonucleotide
ucucuuauuccaaaugugauauaaacg

SEQ ID NO: 6165 - RNA, 27 nt, Artificial Sequence
  Synthetic oligonucleotide
uucucuuauuccaaaugugauauaaac

SEQ ID NO: 6166 - RNA, 27 nt, Artificial Sequence
  Synthetic oligonucleotide
cuucucuuauuccaaaugugauauaaa

SEQ ID NO: 6167 - RNA, 27 nt, Artificial Sequence
  Synthetic oligonucleotide
ucuucucuuauuccaaaugugauauaa

SEQ ID NO: 6168 - RNA, 27 nt, Artificial Sequence
  Synthetic oligonucleotide
gucuucucuuauuccaaaugugauaua

SEQ ID NO: 6169 - RNA, 27 nt, Artificial Sequence
  Synthetic oligonucleotide
agucuucucuuauuccaaaugugauau

SEQ ID NO: 6170 - RNA, 27 nt, Artificial Sequence
  Synthetic oligonucleotide
aagucuucucuuauuccaaaugugaua

SEQ ID NO: 6171 - RNA, 27 nt, Artificial Sequence
  Synthetic oligonucleotide
uaagucuucucuuauuccaaaugugau

SEQ ID NO: 6172 - RNA, 27 nt, Artificial Sequence
  Synthetic oligonucleotide
uuaagucuucucuuauuccaaauguga

SEQ ID NO: 6173 - RNA, 27 nt, Artificial Sequence
  Synthetic oligonucleotide
uuuaagucuucucuuauuccaaaugug

SEQ ID NO: 6174 - RNA, 27 nt, Artificial Sequence
  Synthetic oligonucleotide
uuuuaagucuucucuuauuccaaaugu

SEQ ID NO: 6175 - RNA, 27 nt, Artificial Sequence
  Synthetic oligonucleotide
cuuuuaagucuucucuuauuccaaaug

SEQ ID NO: 6176 - RNA, 27 nt, Artificial Sequence
  Synthetic oligonucleotide
ucuuuuaagucuucucuuauuccaaau

SEQ ID NO: 6177 - RNA, 27 nt, Artificial Sequence
  Synthetic oligonucleotide
aucuuuuaagucuucucuuauuccaaa

SEQ ID NO: 6178 - RNA, 27 nt, Artificial Sequence
  Synthetic oligonucleotide
caucuuuuaagucuucucuuauuccaa

SEQ ID NO: 6179 - RNA, 27 nt, Artificial Sequence
  Synthetic oligonucleotide
ucaucuuuuaagucuucucuuauucca

SEQ ID NO: 6180 - RNA, 27 nt, Artificial Sequence
  Synthetic oligonucleotide
aucaucuuuuaagucuucucuuauucc

SEQ ID NO: 6181 - RNA, 27 nt, Artificial Sequence
  Synthetic oligonucleotide
gaucaucuuuuaagucuucucuuauuc

SEQ ID NO: 6182 - RNA, 27 nt, Artificial Sequence
  Synthetic oligonucleotide
ugaucaucuuuuaagucuucucuuauu

SEQ ID NO: 6183 - RNA, 27 nt, Artificial Sequence
  Synthetic oligonucleotide
uugaucaucuuuuaagucuucucuuau

SEQ ID NO: 6184 - RNA, 27 nt, Artificial Sequence
  Synthetic oligonucleotide
uuugaucaucuuuuaagucuucucuua

SEQ ID NO: 6185 - RNA, 27 nt, Artificial Sequence
  Synthetic oligonucleotide
uuuugaucaucuuuuaagucuucucuu

SEQ ID NO: 6186 - RNA, 27 nt, Artificial Sequence
  Synthetic oligonucleotide
uuuuugaucaucuuuuaagucuucucu

SEQ ID NO: 6187 - RNA, 27 nt, Artificial Sequence
  Synthetic oligonucleotide
cuuuuugaucaucuuuuaagucuucuc

SEQ ID NO: 6188 - RNA, 27 nt, Artificial Sequence
  Synthetic oligonucleotide
ucuuuuugaucaucuuuuaagucuucu

SEQ ID NO: 6189 - RNA, 27 nt, Artificial Sequence
  Synthetic oligonucleotide
uucuuuuugaucaucuuuuaagucuuc

SEQ ID NO: 6190 - RNA, 27 nt, Artificial Sequence
  Synthetic oligonucleotide
uuucuuuuugaucaucuuuuaagucuu

SEQ ID NO: 6191 - RNA, 27 nt, Artificial Sequence
  Synthetic oligonucleotide
auuucuuuuugaucaucuuuuaagucu

SEQ ID NO: 6192 - RNA, 27 nt, Artificial Sequence
  Synthetic oligonucleotide
cauuucuuuuugaucaucuuuuaaguc

SEQ ID NO: 6193 - RNA, 27 nt, Artificial Sequence
  Synthetic oligonucleotide
ucauuucuuuuugaucaucuuuuaagu

SEQ ID NO: 6194 - RNA, 27 nt, Artificial Sequence
  Synthetic oligonucleotide
aucauuucuuuuugaucaucuuuuaag

SEQ ID NO: 6195 - RNA, 27 nt, Artificial Sequence
  Synthetic oligonucleotide
caucauuucuuuuugaucaucuuuuaa

SEQ ID NO: 6196 - RNA, 27 nt, Artificial Sequence
  Synthetic oligonucleotide
gcaucauuucuuuuugaucaucuuuua

SEQ ID NO: 6197 - RNA, 27 nt, Artificial Sequence
  Synthetic oligonucleotide
ugcaucauuucuuuuugaucaucuuuu

SEQ ID NO: 6198 - RNA, 27 nt, Artificial Sequence
  Synthetic oligonucleotide
uugcaucauuucuuuuugaucaucuuu

SEQ ID NO: 6199 - RNA, 27 nt, Artificial Sequence
  Synthetic oligonucleotide
uuugcaucauuucuuuuugaucaucuu

SEQ ID NO: 6200 - RNA, 27 nt, Artificial Sequence
  Synthetic oligonucleotide
guuugcaucauuucuuuuugaucaucu

SEQ ID NO: 6201 - RNA, 27 nt, Artificial Sequence
  Synthetic oligonucleotide
uguuugcaucauuucuuuuugaucauc

SEQ ID NO: 6202 - RNA, 27 nt, Artificial Sequence
  Synthetic oligonucleotide
cuguuugcaucauuucuuuuugaucau

SEQ ID NO: 6203 - RNA, 27 nt, Artificial Sequence
  Synthetic oligonucleotide
gcuguuugcaucauuucuuuuugauca

SEQ ID NO: 6204 - RNA, 27 nt, Artificial Sequence
  Synthetic oligonucleotide
ugcuguuugcaucauuucuuuuugauc

SEQ ID NO: 6205 - RNA, 27 nt, Artificial Sequence
  Synthetic oligonucleotide
uugcuguuugcaucauuucuuuuugau

SEQ ID NO: 6206 - RNA, 27 nt, Artificial Sequence
  Synthetic oligonucleotide
auugcuguuugcaucauuucuuuuuga

SEQ ID NO: 6207 - RNA, 27 nt, Artificial Sequence
  Synthetic oligonucleotide
cauugcuguuugcaucauuucuuuuug

SEQ ID NO: 6208 - RNA, 27 nt, Artificial Sequence
  Synthetic oligonucleotide
gcauugcuguuugcaucauuucuuuuu

SEQ ID NO: 6209 - RNA, 27 nt, Artificial Sequence
  Synthetic oligonucleotide
ugcauugcuguuugcaucauuucuuuu

SEQ ID NO: 6210 - RNA, 27 nt, Artificial Sequence
  Synthetic oligonucleotide
uugcauugcuguuugcaucauuucuuu

SEQ ID NO: 6211 - RNA, 27 nt, Artificial Sequence
  Synthetic oligonucleotide
uuugcauugcuguuugcaucauuucuu

SEQ ID NO: 6212 - RNA, 27 nt, Artificial Sequence
  Synthetic oligonucleotide
uuuugcauugcuguuugcaucauuucu

SEQ ID NO: 6213 - RNA, 27 nt, Artificial Sequence
  Synthetic oligonucleotide
guuuugcauugcuguuugcaucauuuc

SEQ ID NO: 6214 - RNA, 27 nt, Artificial Sequence
  Synthetic oligonucleotide
uguuuugcauugcuguuugcaucauuu

SEQ ID NO: 6215 - RNA, 27 nt, Artificial Sequence
  Synthetic oligonucleotide
guguuuugcauugcuguuugcaucauu

SEQ ID NO: 6216 - RNA, 27 nt, Artificial Sequence
  Synthetic oligonucleotide
cuugagcaauuccauuuaucaacauug

SEQ ID NO: 6217 - RNA, 27 nt, Artificial Sequence
  Synthetic oligonucleotide
gugacuugagcaauuccauuuaucaac

SEQ ID NO: 6218 - RNA, 27 nt, Artificial Sequence
  Synthetic oligonucleotide
ugugacuugagcaauuccauuuaucaa

SEQ ID NO: 6219 - RNA, 27 nt, Artificial Sequence
  Synthetic oligonucleotide
aaugugacuugagcaauuccauuuauc

SEQ ID NO: 6220 - RNA, 27 nt, Artificial Sequence
  Synthetic oligonucleotide
aaaugugacuugagcaauuccauuuau

SEQ ID NO: 6221 - RNA, 27 nt, Artificial Sequence
  Synthetic oligonucleotide
caaaugugacuugagcaauuccauuua

SEQ ID NO: 6222 - RNA, 27 nt, Artificial Sequence
  Synthetic oligonucleotide
aucaaaugugacuugagcaauuccauu

SEQ ID NO: 6223 - RNA, 27 nt, Artificial Sequence
  Synthetic oligonucleotide
aaucaaaugugacuugagcaauuccau

SEQ ID NO: 6224 - RNA, 27 nt, Artificial Sequence
  Synthetic oligonucleotide
gaaucaaaugugacuugagcaauucca

SEQ ID NO: 6225 - RNA, 27 nt, Artificial Sequence
  Synthetic oligonucleotide
agaaucaaaugugacuugagcaauucc

SEQ ID NO: 6226 - RNA, 27 nt, Artificial Sequence
  Synthetic oligonucleotide
cagaaucaaaugugacuugagcaauuc

SEQ ID NO: 6227 - RNA, 27 nt, Artificial Sequence
  Synthetic oligonucleotide
ucagaaucaaaugugacuugagcaauu

SEQ ID NO: 6228 - RNA, 27 nt, Artificial Sequence
  Synthetic oligonucleotide
uucagaaucaaaugugacuugagcaau

SEQ ID NO: 6229 - RNA, 27 nt, Artificial Sequence
  Synthetic oligonucleotide
uuucagaaucaaaugugacuugagcaa

SEQ ID NO: 6230 - RNA, 27 nt, Artificial Sequence
  Synthetic oligonucleotide
uguuucagaaucaaaugugacuugagc

SEQ ID NO: 6231 - RNA, 27 nt, Artificial Sequence
  Synthetic oligonucleotide
cugcuguuucagaaucaaaugugacuu

SEQ ID NO: 6232 - RNA, 27 nt, Artificial Sequence
  Synthetic oligonucleotide
acugcuguuucagaaucaaaugugacu

SEQ ID NO: 6233 - RNA, 27 nt, Artificial Sequence
  Synthetic oligonucleotide
gacugcuguuucagaaucaaaugugac

SEQ ID NO: 6234 - RNA, 27 nt, Artificial Sequence
  Synthetic oligonucleotide
ugacugcuguuucagaaucaaauguga

SEQ ID NO: 6235 - RNA, 27 nt, Artificial Sequence
  Synthetic oligonucleotide
uuugacugcuguuucagaaucaaaugu

SEQ ID NO: 6236 - RNA, 27 nt, Artificial Sequence
  Synthetic oligonucleotide
uucuuugacugcuguuucagaaucaaa

SEQ ID NO: 6237 - RNA, 27 nt, Artificial Sequence
  Synthetic oligonucleotide
guucuuugacugcuguuucagaaucaa

SEQ ID NO: 6238 - RNA, 27 nt, Artificial Sequence
  Synthetic oligonucleotide
aguucuuugacugcuguuucagaauca

SEQ ID NO: 6239 - RNA, 27 nt, Artificial Sequence
  Synthetic oligonucleotide
caguucuuugacugcuguuucagaauc

SEQ ID NO: 6240 - RNA, 27 nt, Artificial Sequence
  Synthetic oligonucleotide
acaguucuuugacugcuguuucagaau

SEQ ID NO: 6241 - RNA, 27 nt, Artificial Sequence
  Synthetic oligonucleotide
gacaguucuuugacugcuguuucagaa

SEQ ID NO: 6242 - RNA, 27 nt, Artificial Sequence
  Synthetic oligonucleotide
ugacaguucuuugacugcuguuucaga

SEQ ID NO: 6243 - RNA, 27 nt, Artificial Sequence
  Synthetic oligonucleotide
augacaguucuuugacugcuguuucag

SEQ ID NO: 6244 - RNA, 27 nt, Artificial Sequence
  Synthetic oligonucleotide
uaugacaguucuuugacugcuguuuca

SEQ ID NO: 6245 - RNA, 27 nt, Artificial Sequence
  Synthetic oligonucleotide
guaugacaguucuuugacugcuguuuc

SEQ ID NO: 6246 - RNA, 27 nt, Artificial Sequence
  Synthetic oligonucleotide
aguaugacaguucuuugacugcuguuu

SEQ ID NO: 6247 - RNA, 27 nt, Artificial Sequence
  Synthetic oligonucleotide
guaguaugacaguucuuugacugcugu

SEQ ID NO: 6248 - RNA, 27 nt, Artificial Sequence
  Synthetic oligonucleotide
cuguaguaugacaguucuuugacugcu

SEQ ID NO: 6249 - RNA, 27 nt, Artificial Sequence
  Synthetic oligonucleotide
acuguaguaugacaguucuuugacugc

SEQ ID NO: 6250 - RNA, 27 nt, Artificial Sequence
  Synthetic oligonucleotide
aaacuguaguaugacaguucuuugacu

SEQ ID NO: 6251 - RNA, 27 nt, Artificial Sequence
  Synthetic oligonucleotide
uaaacuguaguaugacaguucuuugac

SEQ ID NO: 6252 - RNA, 27 nt, Artificial Sequence
  Synthetic oligonucleotide
cuaaacuguaguaugacaguucuuuga

SEQ ID NO: 6253 - RNA, 27 nt, Artificial Sequence
  Synthetic oligonucleotide
cuucuaaacuguaguaugacaguucuu

SEQ ID NO: 6254 - RNA, 27 nt, Artificial Sequence
  Synthetic oligonucleotide
aucuucuaaacuguaguaugacaguuc

SEQ ID NO: 6255 - RNA, 27 nt, Artificial Sequence
  Synthetic oligonucleotide
aaucuucuaaacuguaguaugacaguu

SEQ ID NO: 6256 - RNA, 27 nt, Artificial Sequence
  Synthetic oligonucleotide
aaaucuucuaaacuguaguaugacagu

SEQ ID NO: 6257 - RNA, 27 nt, Artificial Sequence
  Synthetic oligonucleotide
uaaaucuucuaaacuguaguaugacag

SEQ ID NO: 6258 - RNA, 27 nt, Artificial Sequence
  Synthetic oligonucleotide
uuaaaucuucuaaacuguaguaugaca

SEQ ID NO: 6259 - RNA, 27 nt, Artificial Sequence
  Synthetic oligonucleotide
uuuaaaucuucuaaacuguaguaugac

SEQ ID NO: 6260 - RNA, 27 nt, Artificial Sequence
  Synthetic oligonucleotide
guuuaaaucuucuaaacuguaguauga

SEQ ID NO: 6261 - RNA, 27 nt, Artificial Sequence
  Synthetic oligonucleotide
uguuuaaaucuucuaaacuguaguaug

SEQ ID NO: 6262 - RNA, 27 nt, Artificial Sequence
  Synthetic oligonucleotide
uuguuuaaaucuucuaaacuguaguau

SEQ ID NO: 6263 - RNA, 27 nt, Artificial Sequence
  Synthetic oligonucleotide
guuguuuaaaucuucuaaacuguagua

SEQ ID NO: 6264 - RNA, 27 nt, Artificial Sequence
  Synthetic oligonucleotide
uguuguuuaaaucuucuaaacuguagu

SEQ ID NO: 6265 - RNA, 27 nt, Artificial Sequence
  Synthetic oligonucleotide
uuguuguuuaaaucuucuaaacuguag

SEQ ID NO: 6266 - RNA, 27 nt, Artificial Sequence
  Synthetic oligonucleotide
cuuguuguuuaaaucuucuaaacugua

SEQ ID NO: 6267 - RNA, 27 nt, Artificial Sequence
  Synthetic oligonucleotide
acuuguuguuuaaaucuucuaaacugu

SEQ ID NO: 6268 - RNA, 27 nt, Artificial Sequence
  Synthetic oligonucleotide
uacuuguuguuuaaaucuucuaaacug

SEQ ID NO: 6269 - RNA, 27 nt, Artificial Sequence
  Synthetic oligonucleotide
guacuuguuguuuaaaucuucuaaacu

SEQ ID NO: 6270 - RNA, 27 nt, Artificial Sequence
  Synthetic oligonucleotide
gguacuuguuguuuaaaucuucuaaac

SEQ ID NO: 6271 - RNA, 27 nt, Artificial Sequence
  Synthetic oligonucleotide
agguacuuguuguuuaaaucuucuaaa

SEQ ID NO: 6272 - RNA, 27 nt, Artificial Sequence
  Synthetic oligonucleotide
aagguacuuguuguuuaaaucuucuaa

SEQ ID NO: 6273 - RNA, 27 nt, Artificial Sequence
  Synthetic oligonucleotide
aaagguacuuguuguuuaaaucuucua

SEQ ID NO: 6274 - RNA, 27 nt, Artificial Sequence
  Synthetic oligonucleotide
uaaagguacuuguuguuuaaaucuucu

SEQ ID NO: 6275 - RNA, 27 nt, Artificial Sequence
  Synthetic oligonucleotide
auaaagguacuuguuguuuaaaucuuc

SEQ ID NO: 6276 - RNA, 27 nt, Artificial Sequence
  Synthetic oligonucleotide
uauaaagguacuuguuguuuaaaucuu

SEQ ID NO: 6277 - RNA, 27 nt, Artificial Sequence
  Synthetic oligonucleotide
auauaaagguacuuguuguuuaaaucu

SEQ ID NO: 6278 - RNA, 27 nt, Artificial Sequence
  Synthetic oligonucleotide
aauauaaagguacuuguuguuuaaauc

SEQ ID NO: 6279 - RNA, 27 nt, Artificial Sequence
  Synthetic oligonucleotide
ugacuguuacagcaauauaaagguacu

SEQ ID NO: 6280 - RNA, 27 nt, Artificial Sequence
  Synthetic oligonucleotide
uaugacuguuacagcaauauaaaggua

SEQ ID NO: 6281 - RNA, 27 nt, Artificial Sequence
  Synthetic oligonucleotide
cuaugacuguuacagcaauauaaaggu

SEQ ID NO: 6282 - RNA, 27 nt, Artificial Sequence
  Synthetic oligonucleotide
ucuaugacuguuacagcaauauaaagg

SEQ ID NO: 6283 - RNA, 27 nt, Artificial Sequence
  Synthetic oligonucleotide
cucuaugacuguuacagcaauauaaag

SEQ ID NO: 6284 - RNA, 27 nt, Artificial Sequence
  Synthetic oligonucleotide
acucuaugacuguuacagcaauauaaa

SEQ ID NO: 6285 - RNA, 27 nt, Artificial Sequence
  Synthetic oligonucleotide
gacucuaugacuguuacagcaauauaa

SEQ ID NO: 6286 - RNA, 27 nt, Artificial Sequence
  Synthetic oligonucleotide
agacucuaugacuguuacagcaauaua

SEQ ID NO: 6287 - RNA, 27 nt, Artificial Sequence
  Synthetic oligonucleotide
uagacucuaugacuguuacagcaauau

SEQ ID NO: 6288 - RNA, 27 nt, Artificial Sequence
  Synthetic oligonucleotide
guagacucuaugacuguuacagcaaua

SEQ ID NO: 6289 - RNA, 27 nt, Artificial Sequence
  Synthetic oligonucleotide
uguagacucuaugacuguuacagcaau

SEQ ID NO: 6290 - RNA, 27 nt, Artificial Sequence
  Synthetic oligonucleotide
cuguagacucuaugacuguuacagcaa

SEQ ID NO: 6291 - RNA, 27 nt, Artificial Sequence
  Synthetic oligonucleotide
ccuguagacucuaugacuguuacagca

SEQ ID NO: 6292 - RNA, 27 nt, Artificial Sequence
  Synthetic oligonucleotide
accuguagacucuaugacuguuacagc

SEQ ID NO: 6293 - RNA, 27 nt, Artificial Sequence
  Synthetic oligonucleotide
caccuguagacucuaugacuguuacag

SEQ ID NO: 6294 - RNA, 27 nt, Artificial Sequence
  Synthetic oligonucleotide
ccaccuguagacucuaugacuguuaca

SEQ ID NO: 6295 - RNA, 27 nt, Artificial Sequence
  Synthetic oligonucleotide
uccaccuguagacucuaugacuguuac

SEQ ID NO: 6296 - RNA, 27 nt, Artificial Sequence
  Synthetic oligonucleotide
auccaccuguagacucuaugacuguua

SEQ ID NO: 6297 - RNA, 27 nt, Artificial Sequence
  Synthetic oligonucleotide
aauccaccuguagacucuaugacuguu

SEQ ID NO: 6298 - RNA, 27 nt, Artificial Sequence
  Synthetic oligonucleotide
aaauccaccuguagacucuaugacugu

SEQ ID NO: 6299 - RNA, 27 nt, Artificial Sequence
  Synthetic oligonucleotide
aaaauccaccuguagacucuaugacug

SEQ ID NO: 6300 - RNA, 27 nt, Artificial Sequence
  Synthetic oligonucleotide
gaaaauccaccuguagacucuaugacu

SEQ ID NO: 6301 - RNA, 27 nt, Artificial Sequence
  Synthetic oligonucleotide
agaaaauccaccuguagacucuaugac

SEQ ID NO: 6302 - RNA, 27 nt, Artificial Sequence
  Synthetic oligonucleotide
cagaaaauccaccuguagacucuauga

SEQ ID NO: 6303 - RNA, 27 nt, Artificial Sequence
  Synthetic oligonucleotide
ucagaaaauccaccuguagacucuaug

SEQ ID NO: 6304 - RNA, 27 nt, Artificial Sequence
  Synthetic oligonucleotide
uucagaaaauccaccuguagacucuau

SEQ ID NO: 6305 - RNA, 27 nt, Artificial Sequence
  Synthetic oligonucleotide
cuucagaaaauccaccuguagacucua

SEQ ID NO: 6306 - RNA, 27 nt, Artificial Sequence
  Synthetic oligonucleotide
ucuucagaaaauccaccuguagacucu

SEQ ID NO: 6307 - RNA, 27 nt, Artificial Sequence
  Synthetic oligonucleotide
cucuucagaaaauccaccuguagacuc

SEQ ID NO: 6308 - RNA, 27 nt, Artificial Sequence
  Synthetic oligonucleotide
ccucuucagaaaauccaccuguagacu

SEQ ID NO: 6309 - RNA, 27 nt, Artificial Sequence
  Synthetic oligonucleotide
gccucuucagaaaauccaccuguagac

SEQ ID NO: 6310 - RNA, 27 nt, Artificial Sequence
  Synthetic oligonucleotide
ugccucuucagaaaauccaccuguaga

SEQ ID NO: 6311 - RNA, 27 nt, Artificial Sequence
  Synthetic oligonucleotide
cugccucuucagaaaauccaccuguag

SEQ ID NO: 6312 - RNA, 27 nt, Artificial Sequence
  Synthetic oligonucleotide
ucugccucuucagaaaauccaccugua

SEQ ID NO: 6313 - RNA, 27 nt, Artificial Sequence
  Synthetic oligonucleotide
uucugccucuucagaaaauccaccugu

SEQ ID NO: 6314 - RNA, 27 nt, Artificial Sequence
  Synthetic oligonucleotide
uuucugccucuucagaaaauccaccug

SEQ ID NO: 6315 - RNA, 27 nt, Artificial Sequence
  Synthetic oligonucleotide
auuucugccucuucagaaaauccaccu

SEQ ID NO: 6316 - RNA, 27 nt, Artificial Sequence
  Synthetic oligonucleotide
uauuucugccucuucagaaaauccacc

SEQ ID NO: 6317 - RNA, 27 nt, Artificial Sequence
  Synthetic oligonucleotide
guauuucugccucuucagaaaauccac

SEQ ID NO: 6318 - RNA, 27 nt, Artificial Sequence
  Synthetic oligonucleotide
gguauuucugccucuucagaaaaucca

SEQ ID NO: 6319 - RNA, 27 nt, Artificial Sequence
  Synthetic oligonucleotide
agguauuucugccucuucagaaaaucc

SEQ ID NO: 6320 - RNA, 27 nt, Artificial Sequence
  Synthetic oligonucleotide
cagguauuucugccucuucagaaaauc

SEQ ID NO: 6321 - RNA, 27 nt, Artificial Sequence
  Synthetic oligonucleotide
ccagguauuucugccucuucagaaaau

SEQ ID NO: 6322 - RNA, 27 nt, Artificial Sequence
  Synthetic oligonucleotide
gccagguauuucugccucuucagaaaa

SEQ ID NO: 6323 - RNA, 27 nt, Artificial Sequence
  Synthetic oligonucleotide
ugccagguauuucugccucuucagaaa

SEQ ID NO: 6324 - RNA, 27 nt, Artificial Sequence
  Synthetic oligonucleotide
augccagguauuucugccucuucagaa

SEQ ID NO: 6325 - RNA, 27 nt, Artificial Sequence
  Synthetic oligonucleotide
gaugccagguauuucugccucuucaga

SEQ ID NO: 6326 - RNA, 27 nt, Artificial Sequence
  Synthetic oligonucleotide
ugaugccagguauuucugccucuucag

SEQ ID NO: 6327 - RNA, 27 nt, Artificial Sequence
  Synthetic oligonucleotide
uugaugccagguauuucugccucuuca

SEQ ID NO: 6328 - RNA, 27 nt, Artificial Sequence
  Synthetic oligonucleotide
uuugaugccagguauuucugccucuuc

SEQ ID NO: 6329 - RNA, 27 nt, Artificial Sequence
  Synthetic oligonucleotide
auuugaugccagguauuucugccucuu

SEQ ID NO: 6330 - RNA, 27 nt, Artificial Sequence
  Synthetic oligonucleotide
uauuugaugccagguauuucugccucu

SEQ ID NO: 6331 - RNA, 27 nt, Artificial Sequence
  Synthetic oligonucleotide
auauuugaugccagguauuucugccuc

SEQ ID NO: 6332 - RNA, 27 nt, Artificial Sequence
  Synthetic oligonucleotide
cauauuugaugccagguauuucugccu

SEQ ID NO: 6333 - RNA, 27 nt, Artificial Sequence
  Synthetic oligonucleotide
acauauuugaugccagguauuucugcc

SEQ ID NO: 6334 - RNA, 27 nt, Artificial Sequence
  Synthetic oligonucleotide
gacauauuugaugccagguauuucugc

SEQ ID NO: 6335 - RNA, 27 nt, Artificial Sequence
  Synthetic oligonucleotide
ggacauauuugaugccagguauuucug

SEQ ID NO: 6336 - RNA, 27 nt, Artificial Sequence
  Synthetic oligonucleotide
aggacauauuugaugccagguauuucu

SEQ ID NO: 6337 - RNA, 27 nt, Artificial Sequence
  Synthetic oligonucleotide
gaggacauauuugaugccagguauuuc

SEQ ID NO: 6338 - RNA, 27 nt, Artificial Sequence
  Synthetic oligonucleotide
agaggacauauuugaugccagguauuu

SEQ ID NO: 6339 - RNA, 27 nt, Artificial Sequence
  Synthetic oligonucleotide
gagaggacauauuugaugccagguauu

SEQ ID NO: 6340 - RNA, 27 nt, Artificial Sequence
  Synthetic oligonucleotide
agagaggacauauuugaugccagguau

SEQ ID NO: 6341 - RNA, 27 nt, Artificial Sequence
  Synthetic oligonucleotide
gagagaggacauauuugaugccaggua

SEQ ID NO: 6342 - RNA, 27 nt, Artificial Sequence
  Synthetic oligonucleotide
ggagagaggacauauuugaugccaggu

SEQ ID NO: 6343 - RNA, 27 nt, Artificial Sequence
  Synthetic oligonucleotide
gggagagaggacauauuugaugccagg

SEQ ID NO: 6344 - RNA, 27 nt, Artificial Sequence
  Synthetic oligonucleotide
agggagagaggacauauuugaugccag

SEQ ID NO: 6345 - RNA, 27 nt, Artificial Sequence
  Synthetic oligonucleotide
uagggagagaggacauauuugaugcca

SEQ ID NO: 6346 - RNA, 27 nt, Artificial Sequence
  Synthetic oligonucleotide
guagggagagaggacauauuugaugcc

SEQ ID NO: 6347 - RNA, 27 nt, Artificial Sequence
  Synthetic oligonucleotide
uguagggagagaggacauauuugaugc

SEQ ID NO: 6348 - RNA, 27 nt, Artificial Sequence
  Synthetic oligonucleotide
uuuguagggagagaggacauauuugau

SEQ ID NO: 6349 - RNA, 27 nt, Artificial Sequence
  Synthetic oligonucleotide
guuuguagggagagaggacauauuuga

SEQ ID NO: 6350 - RNA, 27 nt, Artificial Sequence
  Synthetic oligonucleotide
aguuuguagggagagaggacauauuug

SEQ ID NO: 6351 - RNA, 27 nt, Artificial Sequence
  Synthetic oligonucleotide
caguuuguagggagagaggacauauuu

SEQ ID NO: 6352 - RNA, 27 nt, Artificial Sequence
  Synthetic oligonucleotide
ucaguuuguagggagagaggacauauu

SEQ ID NO: 6353 - RNA, 27 nt, Artificial Sequence
  Synthetic oligonucleotide
uucaguuuguagggagagaggacauau

SEQ ID NO: 6354 - RNA, 27 nt, Artificial Sequence
  Synthetic oligonucleotide
auucaguuuguagggagagaggacaua

SEQ ID NO: 6355 - RNA, 27 nt, Artificial Sequence
  Synthetic oligonucleotide
aauucaguuuguagggagagaggacau

SEQ ID NO: 6356 - RNA, 27 nt, Artificial Sequence
  Synthetic oligonucleotide
aaauucaguuuguagggagagaggaca

SEQ ID NO: 6357 - RNA, 27 nt, Artificial Sequence
  Synthetic oligonucleotide
caaauucaguuuguagggagagaggac

SEQ ID NO: 6358 - RNA, 27 nt, Artificial Sequence
  Synthetic oligonucleotide
ccaaauucaguuuguagggagagagga

SEQ ID NO: 6359 - RNA, 27 nt, Artificial Sequence
  Synthetic oligonucleotide
accaaauucaguuuguagggagagagg

SEQ ID NO: 6360 - RNA, 27 nt, Artificial Sequence
  Synthetic oligonucleotide
aaccaaauucaguuuguagggagagag

SEQ ID NO: 6361 - RNA, 27 nt, Artificial Sequence
  Synthetic oligonucleotide
caaccaaauucaguuuguagggagaga

SEQ ID NO: 6362 - RNA, 27 nt, Artificial Sequence
  Synthetic oligonucleotide
gcaaccaaauucaguuuguagggagag

SEQ ID NO: 6363 - RNA, 27 nt, Artificial Sequence
  Synthetic oligonucleotide
agcaaccaaauucaguuuguagggaga

SEQ ID NO: 6364 - RNA, 27 nt, Artificial Sequence
  Synthetic oligonucleotide
guagcaaccaaauucaguuuguaggga

SEQ ID NO: 6365 - RNA, 27 nt, Artificial Sequence
  Synthetic oligonucleotide
aguagcaaccaaauucaguuuguaggg

SEQ ID NO: 6366 - RNA, 27 nt, Artificial Sequence
  Synthetic oligonucleotide
gaguagcaaccaaauucaguuuguagg

SEQ ID NO: 6367 - RNA, 27 nt, Artificial Sequence
  Synthetic oligonucleotide
gaggaguagcaaccaaauucaguuugu

SEQ ID NO: 6368 - RNA, 27 nt, Artificial Sequence
  Synthetic oligonucleotide
agaggaguagcaaccaaauucaguuug

SEQ ID NO: 6369 - RNA, 27 nt, Artificial Sequence
  Synthetic oligonucleotide
aagaggaguagcaaccaaauucaguuu

SEQ ID NO: 6370 - RNA, 27 nt, Artificial Sequence
  Synthetic oligonucleotide
aaagaggaguagcaaccaaauucaguu

SEQ ID NO: 6371 - RNA, 27 nt, Artificial Sequence
  Synthetic oligonucleotide
aaaagaggaguagcaaccaaauucagu

SEQ ID NO: 6372 - RNA, 27 nt, Artificial Sequence
  Synthetic oligonucleotide
gaaaagaggaguagcaaccaaauucag

SEQ ID NO: 6373 - RNA, 27 nt, Artificial Sequence
  Synthetic oligonucleotide
ggaaaagaggaguagcaaccaaauuca

SEQ ID NO: 6374 - RNA, 27 nt, Artificial Sequence
  Synthetic oligonucleotide
aggaaaagaggaguagcaaccaaauuc

SEQ ID NO: 6375 - RNA, 27 nt, Artificial Sequence
  Synthetic oligonucleotide
caggaaaagaggaguagcaaccaaauu

SEQ ID NO: 6376 - RNA, 27 nt, Artificial Sequence
  Synthetic oligonucleotide
ucaggaaaagaggaguagcaaccaaau

SEQ ID NO: 6377 - RNA, 27 nt, Artificial Sequence
  Synthetic oligonucleotide
uucaggaaaagaggaguagcaaccaaa

SEQ ID NO: 6378 - RNA, 27 nt, Artificial Sequence
  Synthetic oligonucleotide
cuucaggaaaagaggaguagcaaccaa

SEQ ID NO: 6379 - RNA, 27 nt, Artificial Sequence
  Synthetic oligonucleotide
gcuucaggaaaagaggaguagcaacca

SEQ ID NO: 6380 - RNA, 27 nt, Artificial Sequence
  Synthetic oligonucleotide
ggcuucaggaaaagaggaguagcaacc

SEQ ID NO: 6381 - RNA, 27 nt, Artificial Sequence
  Synthetic oligonucleotide
aggcuucaggaaaagaggaguagcaac

SEQ ID NO: 6382 - RNA, 27 nt, Artificial Sequence
  Synthetic oligonucleotide
caggcuucaggaaaagaggaguagcaa

SEQ ID NO: 6383 - RNA, 27 nt, Artificial Sequence
  Synthetic oligonucleotide
ccaggcuucaggaaaagaggaguagca

SEQ ID NO: 6384 - RNA, 27 nt, Artificial Sequence
  Synthetic oligonucleotide
cccaggcuucaggaaaagaggaguagc

SEQ ID NO: 6385 - RNA, 27 nt, Artificial Sequence
  Synthetic oligonucleotide
ucccaggcuucaggaaaagaggaguag

SEQ ID NO: 6386 - RNA, 27 nt, Artificial Sequence
  Synthetic oligonucleotide
aucccaggcuucaggaaaagaggagua

SEQ ID NO: 6387 - RNA, 27 nt, Artificial Sequence
  Synthetic oligonucleotide
aaucccaggcuucaggaaaagaggagu

SEQ ID NO: 6388 - RNA, 27 nt, Artificial Sequence
  Synthetic oligonucleotide
gaaucccaggcuucaggaaaagaggag

SEQ ID NO: 6389 - RNA, 27 nt, Artificial Sequence
  Synthetic oligonucleotide
ggaaucccaggcuucaggaaaagagga

SEQ ID NO: 6390 - RNA, 27 nt, Artificial Sequence
  Synthetic oligonucleotide
uggaaucccaggcuucaggaaaagagg

SEQ ID NO: 6391 - RNA, 27 nt, Artificial Sequence
  Synthetic oligonucleotide
auggaaucccaggcuucaggaaaagag

SEQ ID NO: 6392 - RNA, 27 nt, Artificial Sequence
  Synthetic oligonucleotide
uauggaaucccaggcuucaggaaaaga

SEQ ID NO: 6393 - RNA, 27 nt, Artificial Sequence
  Synthetic oligonucleotide
auauggaaucccaggcuucaggaaaag

SEQ ID NO: 6394 - RNA, 27 nt, Artificial Sequence
  Synthetic oligonucleotide
gauauggaaucccaggcuucaggaaaa

SEQ ID NO: 6395 - RNA, 27 nt, Artificial Sequence
  Synthetic oligonucleotide
ggauauggaaucccaggcuucaggaaa

SEQ ID NO: 6396 - RNA, 27 nt, Artificial Sequence
  Synthetic oligonucleotide
gggauauggaaucccaggcuucaggaa

SEQ ID NO: 6397 - RNA, 27 nt, Artificial Sequence
  Synthetic oligonucleotide
ugggauauggaaucccaggcuucagga

SEQ ID NO: 6398 - RNA, 27 nt, Artificial Sequence
  Synthetic oligonucleotide
augggauauggaaucccaggcuucagg

SEQ ID NO: 6399 - RNA, 27 nt, Artificial Sequence
  Synthetic oligonucleotide
gaugggauauggaaucccaggcuucag

SEQ ID NO: 6400 - RNA, 27 nt, Artificial Sequence
  Synthetic oligonucleotide
gaaucuuuaaccugcaccuugauggga

SEQ ID NO: 6401 - RNA, 27 nt, Artificial Sequence
  Synthetic oligonucleotide
cgaaucuuuaaccugcaccuugauggg

SEQ ID NO: 6402 - RNA, 27 nt, Artificial Sequence
  Synthetic oligonucleotide
gcgaaucuuuaaccugcaccuugaugg

SEQ ID NO: 6403 - RNA, 27 nt, Artificial Sequence
  Synthetic oligonucleotide
agcgaaucuuuaaccugcaccuugaug

SEQ ID NO: 6404 - RNA, 27 nt, Artificial Sequence
  Synthetic oligonucleotide
aagcgaaucuuuaaccugcaccuugau

SEQ ID NO: 6405 - RNA, 27 nt, Artificial Sequence
  Synthetic oligonucleotide
acuccuccuaccaacuggucaagcgaa

SEQ ID NO: 6406 - RNA, 27 nt, Artificial Sequence
  Synthetic oligonucleotide
gacuccuccuaccaacuggucaagcga

SEQ ID NO: 6407 - RNA, 27 nt, Artificial Sequence
  Synthetic oligonucleotide
ggacuccuccuaccaacuggucaagcg

SEQ ID NO: 6408 - RNA, 27 nt, Artificial Sequence
  Synthetic oligonucleotide
gggacuccuccuaccaacuggucaagc

SEQ ID NO: 6409 - RNA, 27 nt, Artificial Sequence
  Synthetic oligonucleotide
uuugugcauucaguguuacugggacuc

SEQ ID NO: 6410 - RNA, 27 nt, Artificial Sequence
  Synthetic oligonucleotide
guuugugcauucaguguuacugggacu

SEQ ID NO: 6411 - RNA, 27 nt, Artificial Sequence
  Synthetic oligonucleotide
uguuugugcauucaguguuacugggac

SEQ ID NO: 6412 - RNA, 27 nt, Artificial Sequence
  Synthetic oligonucleotide
uuguuugugcauucaguguuacuggga

SEQ ID NO: 6413 - RNA, 27 nt, Artificial Sequence
  Synthetic oligonucleotide
auuguuugugcauucaguguuacuggg

SEQ ID NO: 6414 - RNA, 27 nt, Artificial Sequence
  Synthetic oligonucleotide
aauuguuugugcauucaguguuacugg

SEQ ID NO: 6415 - RNA, 27 nt, Artificial Sequence
  Synthetic oligonucleotide
caauuguuugugcauucaguguuacug

SEQ ID NO: 6416 - RNA, 27 nt, Artificial Sequence
  Synthetic oligonucleotide
ucaauuguuugugcauucaguguuacu

SEQ ID NO: 6417 - RNA, 27 nt, Artificial Sequence
  Synthetic oligonucleotide
aucaauuguuugugcauucaguguuac

SEQ ID NO: 6418 - RNA, 27 nt, Artificial Sequence
  Synthetic oligonucleotide
caucaauuguuugugcauucaguguua

SEQ ID NO: 6419 - RNA, 27 nt, Artificial Sequence
  Synthetic oligonucleotide
acaucaauuguuugugcauucaguguu

SEQ ID NO: 6420 - RNA, 27 nt, Artificial Sequence
  Synthetic oligonucleotide
uacaucaauuguuugugcauucagugu

SEQ ID NO: 6421 - RNA, 27 nt, Artificial Sequence
  Synthetic oligonucleotide
guuuacaucaauuguuugugcauucag

SEQ ID NO: 6422 - RNA, 27 nt, Artificial Sequence
  Synthetic oligonucleotide
gguuuacaucaauuguuugugcauuca

SEQ ID NO: 6423 - RNA, 27 nt, Artificial Sequence
  Synthetic oligonucleotide
ugguuuacaucaauuguuugugcauuc

SEQ ID NO: 6424 - RNA, 27 nt, Artificial Sequence
  Synthetic oligonucleotide
gauccaagucagaugucucuugguuua

SEQ ID NO: 6425 - RNA, 27 nt, Artificial Sequence
  Synthetic oligonucleotide
ggauccaagucagaugucucuugguuu

SEQ ID NO: 6426 - RNA, 27 nt, Artificial Sequence
  Synthetic oligonucleotide
uggauccaagucagaugucucuugguu

SEQ ID NO: 6427 - RNA, 27 nt, Artificial Sequence
  Synthetic oligonucleotide
caucaucaacacguguuacacuuuugc

SEQ ID NO: 6428 - RNA, 27 nt, Artificial Sequence
  Synthetic oligonucleotide
ccaucaucaacacguguuacacuuuug

SEQ ID NO: 6429 - RNA, 27 nt, Artificial Sequence
  Synthetic oligonucleotide
uccaucaucaacacguguuacacuuuu

SEQ ID NO: 6430 - RNA, 27 nt, Artificial Sequence
  Synthetic oligonucleotide
cuccaucaucaacacguguuacacuuu

SEQ ID NO: 6431 - RNA, 27 nt, Artificial Sequence
  Synthetic oligonucleotide
acuccaucaucaacacguguuacacuu

SEQ ID NO: 6432 - RNA, 27 nt, Artificial Sequence
  Synthetic oligonucleotide
uacuccaucaucaacacguguuacacu

SEQ ID NO: 6433 - RNA, 27 nt, Artificial Sequence
  Synthetic oligonucleotide
cuacuccaucaucaacacguguuacac

SEQ ID NO: 6434 - RNA, 27 nt, Artificial Sequence
  Synthetic oligonucleotide
gcuacuccaucaucaacacguguuaca

SEQ ID NO: 6435 - RNA, 27 nt, Artificial Sequence
  Synthetic oligonucleotide
agcuacuccaucaucaacacguguuac

SEQ ID NO: 6436 - RNA, 27 nt, Artificial Sequence
  Synthetic oligonucleotide
aagcuacuccaucaucaacacguguua

SEQ ID NO: 6437 - RNA, 27 nt, Artificial Sequence
  Synthetic oligonucleotide
gaagcuacuccaucaucaacacguguu

SEQ ID NO: 6438 - RNA, 27 nt, Artificial Sequence
  Synthetic oligonucleotide
ggaagcuacuccaucaucaacacgugu

SEQ ID NO: 6439 - RNA, 27 nt, Artificial Sequence
  Synthetic oligonucleotide
aggaagcuacuccaucaucaacacgug

SEQ ID NO: 6440 - RNA, 27 nt, Artificial Sequence
  Synthetic oligonucleotide
aaggaagcuacuccaucaucaacacgu

SEQ ID NO: 6441 - RNA, 27 nt, Artificial Sequence
  Synthetic oligonucleotide
aaaggaagcuacuccaucaucaacacg

SEQ ID NO: 6442 - RNA, 27 nt, Artificial Sequence
  Synthetic oligonucleotide
caaaggaagcuacuccaucaucaacac

SEQ ID NO: 6443 - RNA, 27 nt, Artificial Sequence
  Synthetic oligonucleotide
acaaaggaagcuacuccaucaucaaca

SEQ ID NO: 6444 - RNA, 27 nt, Artificial Sequence
  Synthetic oligonucleotide
accgucacuccagaugggagauuaagc

SEQ ID NO: 6445 - RNA, 27 nt, Artificial Sequence
  Synthetic oligonucleotide
caccgucacuccagaugggagauuaag

SEQ ID NO: 6446 - RNA, 27 nt, Artificial Sequence
  Synthetic oligonucleotide
gcaccgucacuccagaugggagauuaa

SEQ ID NO: 6447 - RNA, 27 nt, Artificial Sequence
  Synthetic oligonucleotide
agcaccgucacuccagaugggagauua

SEQ ID NO: 6448 - RNA, 27 nt, Artificial Sequence
  Synthetic oligonucleotide
cagcaccgucacuccagaugggagauu

SEQ ID NO: 6449 - RNA, 27 nt, Artificial Sequence
  Synthetic oligonucleotide
uccagcaccgucacuccagaugggaga

SEQ ID NO: 6450 - RNA, 27 nt, Artificial Sequence
  Synthetic oligonucleotide
acuccagcaccgucacuccagauggga

SEQ ID NO: 6451 - RNA, 27 nt, Artificial Sequence
  Synthetic oligonucleotide
aacuccagcaccgucacuccagauggg

SEQ ID NO: 6452 - RNA, 27 nt, Artificial Sequence
  Synthetic oligonucleotide
aaacuccagcaccgucacuccagaugg

SEQ ID NO: 6453 - RNA, 27 nt, Artificial Sequence
  Synthetic oligonucleotide
uaaacuccagcaccgucacuccagaug

SEQ ID NO: 6454 - RNA, 27 nt, Artificial Sequence
  Synthetic oligonucleotide
uuaaacuccagcaccgucacuccagau

SEQ ID NO: 6455 - RNA, 27 nt, Artificial Sequence
  Synthetic oligonucleotide
auuaaacuccagcaccgucacuccaga

SEQ ID NO: 6456 - RNA, 27 nt, Artificial Sequence
  Synthetic oligonucleotide
cauuaaacuccagcaccgucacuccag

SEQ ID NO: 6457 - RNA, 27 nt, Artificial Sequence
  Synthetic oligonucleotide
acauuaaacuccagcaccgucacucca

SEQ ID NO: 6458 - RNA, 27 nt, Artificial Sequence
  Synthetic oligonucleotide
gacauuaaacuccagcaccgucacucc

SEQ ID NO: 6459 - RNA, 27 nt, Artificial Sequence
  Synthetic oligonucleotide
ugacauuaaacuccagcaccgucacuc

SEQ ID NO: 6460 - RNA, 27 nt, Artificial Sequence
  Synthetic oligonucleotide
uugacauuaaacuccagcaccgucacu

SEQ ID NO: 6461 - RNA, 27 nt, Artificial Sequence
  Synthetic oligonucleotide
uuugacauuaaacuccagcaccgucac

SEQ ID NO: 6462 - RNA, 27 nt, Artificial Sequence
  Synthetic oligonucleotide
uuuugacauuaaacuccagcaccguca

SEQ ID NO: 6463 - RNA, 27 nt, Artificial Sequence
  Synthetic oligonucleotide
guuuugacauuaaacuccagcaccguc

SEQ ID NO: 6464 - RNA, 27 nt, Artificial Sequence
  Synthetic oligonucleotide
aguuuugacauuaaacuccagcaccgu

SEQ ID NO: 6465 - RNA, 27 nt, Artificial Sequence
  Synthetic oligonucleotide
caguuuugacauuaaacuccagcaccg

SEQ ID NO: 6466 - RNA, 27 nt, Artificial Sequence
  Synthetic oligonucleotide
ucaguuuugacauuaaacuccagcacc

SEQ ID NO: 6467 - RNA, 27 nt, Artificial Sequence
  Synthetic oligonucleotide
aucaguuuugacauuaaacuccagcac

SEQ ID NO: 6468 - RNA, 27 nt, Artificial Sequence
  Synthetic oligonucleotide
caucaguuuugacauuaaacuccagca

SEQ ID NO: 6469 - RNA, 27 nt, Artificial Sequence
  Synthetic oligonucleotide
gcaucaguuuugacauuaaacuccagc

SEQ ID NO: 6470 - RNA, 27 nt, Artificial Sequence
  Synthetic oligonucleotide
agcaucaguuuugacauuaaacuccag

SEQ ID NO: 6471 - RNA, 27 nt, Artificial Sequence
  Synthetic oligonucleotide
gagcaucaguuuugacauuaaacucca

SEQ ID NO: 6472 - RNA, 27 nt, Artificial Sequence
  Synthetic oligonucleotide
ggagcaucaguuuugacauuaaacucc

SEQ ID NO: 6473 - RNA, 27 nt, Artificial Sequence
  Synthetic oligonucleotide
uggagcaucaguuuugacauuaaacuc

SEQ ID NO: 6474 - RNA, 27 nt, Artificial Sequence
  Synthetic oligonucleotide
cuggagcaucaguuuugacauuaaacu

SEQ ID NO: 6475 - RNA, 27 nt, Artificial Sequence
  Synthetic oligonucleotide
ucuggagcaucaguuuugacauuaaac

SEQ ID NO: 6476 - RNA, 27 nt, Artificial Sequence
  Synthetic oligonucleotide
aucuggagcaucaguuuugacauuaaa

SEQ ID NO: 6477 - RNA, 27 nt, Artificial Sequence
  Synthetic oligonucleotide
gaucuggagcaucaguuuugacauuaa

SEQ ID NO: 6478 - RNA, 27 nt, Artificial Sequence
  Synthetic oligonucleotide
agaucuggagcaucaguuuugacauua

SEQ ID NO: 6479 - RNA, 27 nt, Artificial Sequence
  Synthetic oligonucleotide
aagaucuggagcaucaguuuugacauu

SEQ ID NO: 6480 - RNA, 27 nt, Artificial Sequence
  Synthetic oligonucleotide
gaagaucuggagcaucaguuuugacau

SEQ ID NO: 6481 - RNA, 27 nt, Artificial Sequence
  Synthetic oligonucleotide
ggaagaucuggagcaucaguuuugaca

SEQ ID NO: 6482 - RNA, 27 nt, Artificial Sequence
  Synthetic oligonucleotide
uggaagaucuggagcaucaguuuugac

SEQ ID NO: 6483 - RNA, 27 nt, Artificial Sequence
  Synthetic oligonucleotide
cuggaagaucuggagcaucaguuuuga

SEQ ID NO: 6484 - RNA, 27 nt, Artificial Sequence
  Synthetic oligonucleotide
ucuggaagaucuggagcaucaguuuug

SEQ ID NO: 6485 - RNA, 27 nt, Artificial Sequence
  Synthetic oligonucleotide
uucuggaagaucuggagcaucaguuuu

SEQ ID NO: 6486 - RNA, 27 nt, Artificial Sequence
  Synthetic oligonucleotide
cuucuggaagaucuggagcaucaguuu

SEQ ID NO: 6487 - RNA, 27 nt, Artificial Sequence
  Synthetic oligonucleotide
ucuucuggaagaucuggagcaucaguu

SEQ ID NO: 6488 - RNA, 27 nt, Artificial Sequence
  Synthetic oligonucleotide
uucuucuggaagaucuggagcaucagu

SEQ ID NO: 6489 - RNA, 27 nt, Artificial Sequence
  Synthetic oligonucleotide
uuucuucuggaagaucuggagcaucag

SEQ ID NO: 6490 - RNA, 27 nt, Artificial Sequence
  Synthetic oligonucleotide
uuuucuucuggaagaucuggagcauca

SEQ ID NO: 6491 - RNA, 27 nt, Artificial Sequence
  Synthetic oligonucleotide
gguaaccuucccuggccugauuuucuu

SEQ ID NO: 6492 - RNA, 27 nt, Artificial Sequence
  Synthetic oligonucleotide
cgguaaccuucccuggccugauuuucu

SEQ ID NO: 6493 - RNA, 27 nt, Artificial Sequence
  Synthetic oligonucleotide
ucgguaaccuucccuggccugauuuuc

SEQ ID NO: 6494 - RNA, 27 nt, Artificial Sequence
  Synthetic oligonucleotide
cucgguaaccuucccuggccugauuuu

SEQ ID NO: 6495 - RNA, 27 nt, Artificial Sequence
  Synthetic oligonucleotide
gcucgguaaccuucccuggccugauuu

SEQ ID NO: 6496 - RNA, 27 nt, Artificial Sequence
  Synthetic oligonucleotide
ugcucgguaaccuucccuggccugauu

SEQ ID NO: 6497 - RNA, 27 nt, Artificial Sequence
  Synthetic oligonucleotide
uugcucgguaaccuucccuggccugau

SEQ ID NO: 6498 - RNA, 27 nt, Artificial Sequence
  Synthetic oligonucleotide
auugcucgguaaccuucccuggccuga

SEQ ID NO: 6499 - RNA, 27 nt, Artificial Sequence
  Synthetic oligonucleotide
uauugcucgguaaccuucccuggccug

SEQ ID NO: 6500 - RNA, 27 nt, Artificial Sequence
  Synthetic oligonucleotide
cuauugcucgguaaccuucccuggccu

SEQ ID NO: 6501 - RNA, 27 nt, Artificial Sequence
  Synthetic oligonucleotide
gcuauugcucgguaaccuucccuggcc

SEQ ID NO: 6502 - RNA, 27 nt, Artificial Sequence
  Synthetic oligonucleotide
ugcuauugcucgguaaccuucccuggc

SEQ ID NO: 6503 - RNA, 27 nt, Artificial Sequence
  Synthetic oligonucleotide
augcuauugcucgguaaccuucccugg

SEQ ID NO: 6504 - RNA, 27 nt, Artificial Sequence
  Synthetic oligonucleotide
uaugcuauugcucgguaaccuucccug

SEQ ID NO: 6505 - RNA, 27 nt, Artificial Sequence
  Synthetic oligonucleotide
guaugcuauugcucgguaaccuucccu

SEQ ID NO: 6506 - RNA, 27 nt, Artificial Sequence
  Synthetic oligonucleotide
aguaugcuauugcucgguaaccuuccc

SEQ ID NO: 6507 - RNA, 27 nt, Artificial Sequence
  Synthetic oligonucleotide
gaguaugcuauugcucgguaaccuucc

SEQ ID NO: 6508 - RNA, 27 nt, Artificial Sequence
  Synthetic oligonucleotide
ugaguaugcuauugcucgguaaccuuc

SEQ ID NO: 6509 - RNA, 27 nt, Artificial Sequence
  Synthetic oligonucleotide
gaugaguaugcuauugcucgguaaccu

SEQ ID NO: 6510 - RNA, 27 nt, Artificial Sequence
  Synthetic oligonucleotide
agaugaguaugcuauugcucgguaacc

SEQ ID NO: 6511 - RNA, 27 nt, Artificial Sequence
  Synthetic oligonucleotide
gagaugaguaugcuauugcucgguaac

SEQ ID NO: 6512 - RNA, 27 nt, Artificial Sequence
  Synthetic oligonucleotide
agagaugaguaugcuauugcucgguaa

SEQ ID NO: 6513 - RNA, 27 nt, Artificial Sequence
  Synthetic oligonucleotide
gagagaugaguaugcuauugcucggua

SEQ ID NO: 6514 - RNA, 27 nt, Artificial Sequence
  Synthetic oligonucleotide
ugagagaugaguaugcuauugcucggu

SEQ ID NO: 6515 - RNA, 27 nt, Artificial Sequence
  Synthetic oligonucleotide
cugagagaugaguaugcuauugcucgg

SEQ ID NO: 6516 - RNA, 27 nt, Artificial Sequence
  Synthetic oligonucleotide
gcugagagaugaguaugcuauugcucg

SEQ ID NO: 6517 - RNA, 27 nt, Artificial Sequence
  Synthetic oligonucleotide
ggcugagagaugaguaugcuauugcuc

SEQ ID NO: 6518 - RNA, 27 nt, Artificial Sequence
  Synthetic oligonucleotide
uggcugagagaugaguaugcuauugcu

SEQ ID NO: 6519 - RNA, 27 nt, Artificial Sequence
  Synthetic oligonucleotide
uuggcugagagaugaguaugcuauugc

SEQ ID NO: 6520 - RNA, 27 nt, Artificial Sequence
  Synthetic oligonucleotide
uuuggcugagagaugaguaugcuauug

SEQ ID NO: 6521 - RNA, 27 nt, Artificial Sequence
  Synthetic oligonucleotide
cuuuggcugagagaugaguaugcuauu

SEQ ID NO: 6522 - RNA, 27 nt, Artificial Sequence
  Synthetic oligonucleotide
acuuuggcugagagaugaguaugcuau

SEQ ID NO: 6523 - RNA, 27 nt, Artificial Sequence
  Synthetic oligonucleotide
aacuuuggcugagagaugaguaugcua

SEQ ID NO: 6524 - RNA, 27 nt, Artificial Sequence
  Synthetic oligonucleotide
uaacuuuggcugagagaugaguaugcu

SEQ ID NO: 6525 - RNA, 27 nt, Artificial Sequence
  Synthetic oligonucleotide
guaacuuuggcugagagaugaguaugc

SEQ ID NO: 6526 - RNA, 27 nt, Artificial Sequence
  Synthetic oligonucleotide
gguaacuuuggcugagagaugaguaug

SEQ ID NO: 6527 - RNA, 27 nt, Artificial Sequence
  Synthetic oligonucleotide
agguaacuuuggcugagagaugaguau

SEQ ID NO: 6528 - RNA, 27 nt, Artificial Sequence
  Synthetic oligonucleotide
aagguaacuuuggcugagagaugagua

SEQ ID NO: 6529 - RNA, 27 nt, Artificial Sequence
  Synthetic oligonucleotide
aaagguaacuuuggcugagagaugagu

SEQ ID NO: 6530 - RNA, 27 nt, Artificial Sequence
  Synthetic oligonucleotide
uaaagguaacuuuggcugagagaugag

SEQ ID NO: 6531 - RNA, 27 nt, Artificial Sequence
  Synthetic oligonucleotide
auaaagguaacuuuggcugagagauga

SEQ ID NO: 6532 - RNA, 27 nt, Artificial Sequence
  Synthetic oligonucleotide
uauaaagguaacuuuggcugagagaug

SEQ ID NO: 6533 - RNA, 27 nt, Artificial Sequence
  Synthetic oligonucleotide
auauaaagguaacuuuggcugagagau

SEQ ID NO: 6534 - RNA, 27 nt, Artificial Sequence
  Synthetic oligonucleotide
aauauaaagguaacuuuggcugagaga

SEQ ID NO: 6535 - RNA, 27 nt, Artificial Sequence
  Synthetic oligonucleotide
caauauaaagguaacuuuggcugagag

SEQ ID NO: 6536 - RNA, 27 nt, Artificial Sequence
  Synthetic oligonucleotide
gauguucucccacuagcaaagccuuau

SEQ ID NO: 6537 - RNA, 27 nt, Artificial Sequence
  Synthetic oligonucleotide
agauguucucccacuagcaaagccuua

SEQ ID NO: 6538 - RNA, 27 nt, Artificial Sequence
  Synthetic oligonucleotide
cagauguucucccacuagcaaagccuu

SEQ ID NO: 6539 - RNA, 27 nt, Artificial Sequence
  Synthetic oligonucleotide
auuuugucaauauaugggcuuuugggg

SEQ ID NO: 6540 - RNA, 27 nt, Artificial Sequence
  Synthetic oligonucleotide
uauuuugucaauauaugggcuuuuggg

SEQ ID NO: 6541 - RNA, 27 nt, Artificial Sequence
  Synthetic oligonucleotide
guuauuuugucaauauaugggcuuuug

SEQ ID NO: 6542 - RNA, 27 nt, Artificial Sequence
  Synthetic oligonucleotide
aguuauuuugucaauauaugggcuuuu

SEQ ID NO: 6543 - RNA, 27 nt, Artificial Sequence
  Synthetic oligonucleotide
gaguuauuuugucaauauaugggcuuu

SEQ ID NO: 6544 - RNA, 27 nt, Artificial Sequence
  Synthetic oligonucleotide
agugaguuauuuugucaauauaugggc

SEQ ID NO: 6545 - RNA, 27 nt, Artificial Sequence
  Synthetic oligonucleotide
uuauagugaguuauuuugucaauauau

SEQ ID NO: 6546 - RNA, 27 nt, Artificial Sequence
  Synthetic oligonucleotide
auuauagugaguuauuuugucaauaua

SEQ ID NO: 6547 - RNA, 27 nt, Artificial Sequence
  Synthetic oligonucleotide
uaauuauagugaguuauuuugucaaua

SEQ ID NO: 6548 - RNA, 27 nt, Artificial Sequence
  Synthetic oligonucleotide
uuuugcccuuggauaaaaucaaguaau

SEQ ID NO: 6549 - RNA, 27 nt, Artificial Sequence
  Synthetic oligonucleotide
auuuugcccuuggauaaaaucaaguaa

SEQ ID NO: 6550 - RNA, 27 nt, Artificial Sequence
  Synthetic oligonucleotide
aauuuugcccuuggauaaaaucaagua

SEQ ID NO: 6551 - RNA, 27 nt, Artificial Sequence
  Synthetic oligonucleotide
uaauuuugcccuuggauaaaaucaagu

SEQ ID NO: 6552 - RNA, 27 nt, Artificial Sequence
  Synthetic oligonucleotide
auaauuuugcccuuggauaaaaucaag

SEQ ID NO: 6553 - RNA, 27 nt, Artificial Sequence
  Synthetic oligonucleotide
gauaauuuugcccuuggauaaaaucaa

SEQ ID NO: 6554 - RNA, 27 nt, Artificial Sequence
  Synthetic oligonucleotide
ggauaauuuugcccuuggauaaaauca

SEQ ID NO: 6555 - RNA, 27 nt, Artificial Sequence
  Synthetic oligonucleotide
uggauaauuuugcccuuggauaaaauc

SEQ ID NO: 6556 - RNA, 27 nt, Artificial Sequence
  Synthetic oligonucleotide
guggauaauuuugcccuuggauaaaau

SEQ ID NO: 6557 - RNA, 27 nt, Artificial Sequence
  Synthetic oligonucleotide
aguggauaauuuugcccuuggauaaaa

SEQ ID NO: 6558 - RNA, 27 nt, Artificial Sequence
  Synthetic oligonucleotide
aaguggauaauuuugcccuuggauaaa

SEQ ID NO: 6559 - RNA, 27 nt, Artificial Sequence
  Synthetic oligonucleotide
aaaguggauaauuuugcccuuggauaa

SEQ ID NO: 6560 - RNA, 27 nt, Artificial Sequence
  Synthetic oligonucleotide
caaaguggauaauuuugcccuuggaua

SEQ ID NO: 6561 - RNA, 27 nt, Artificial Sequence
  Synthetic oligonucleotide
ccaaaguggauaauuuugcccuuggau

SEQ ID NO: 6562 - RNA, 27 nt, Artificial Sequence
  Synthetic oligonucleotide
gccaaaguggauaauuuugcccuugga

SEQ ID NO: 6563 - RNA, 27 nt, Artificial Sequence
  Synthetic oligonucleotide
ugccaaaguggauaauuuugcccuugg

SEQ ID NO: 6564 - RNA, 27 nt, Artificial Sequence
  Synthetic oligonucleotide
gugccaaaguggauaauuuugcccuug

SEQ ID NO: 6565 - RNA, 27 nt, Artificial Sequence
  Synthetic oligonucleotide
cgugccaaaguggauaauuuugcccuu

SEQ ID NO: 6566 - RNA, 27 nt, Artificial Sequence
  Synthetic oligonucleotide
ucgugccaaaguggauaauuuugcccu

SEQ ID NO: 6567 - RNA, 27 nt, Artificial Sequence
  Synthetic oligonucleotide
cucgugccaaaguggauaauuuugccc

SEQ ID NO: 6568 - RNA, 27 nt, Artificial Sequence
  Synthetic oligonucleotide
ccucgugccaaaguggauaauuuugcc

SEQ ID NO: 6569 - RNA, 27 nt, Artificial Sequence
  Synthetic oligonucleotide
cccucgugccaaaguggauaauuuugc

SEQ ID NO: 6570 - RNA, 27 nt, Artificial Sequence
  Synthetic oligonucleotide
ucccucgugccaaaguggauaauuuug

SEQ ID NO: 6571 - RNA, 27 nt, Artificial Sequence
  Synthetic oligonucleotide
auacuuugauaagaugcaucugaaaau

SEQ ID NO: 6572 - RNA, 27 nt, Artificial Sequence
  Synthetic oligonucleotide
uauacuuugauaagaugcaucugaaaa

SEQ ID NO: 6573 - RNA, 27 nt, Artificial Sequence
  Synthetic oligonucleotide
uuauacuuugauaagaugcaucugaaa

SEQ ID NO: 6574 - RNA, 27 nt, Artificial Sequence
  Synthetic oligonucleotide
uuuauacuuugauaagaugcaucugaa

SEQ ID NO: 6575 - RNA, 27 nt, Artificial Sequence
  Synthetic oligonucleotide
guuuauacuuugauaagaugcaucuga

SEQ ID NO: 6576 - RNA, 27 nt, Artificial Sequence
  Synthetic oligonucleotide
uguuuauacuuugauaagaugcaucug

SEQ ID NO: 6577 - RNA, 27 nt, Artificial Sequence
  Synthetic oligonucleotide
auguuuauacuuugauaagaugcaucu

SEQ ID NO: 6578 - RNA, 27 nt, Artificial Sequence
  Synthetic oligonucleotide
aauguuuauacuuugauaagaugcauc

SEQ ID NO: 6579 - RNA, 27 nt, Artificial Sequence
  Synthetic oligonucleotide
gaauguuuauacuuugauaagaugcau

SEQ ID NO: 6580 - RNA, 27 nt, Artificial Sequence
  Synthetic oligonucleotide
ggaauguuuauacuuugauaagaugca

SEQ ID NO: 6581 - RNA, 27 nt, Artificial Sequence
  Synthetic oligonucleotide
uggaauguuuauacuuugauaagaugc

SEQ ID NO: 6582 - RNA, 27 nt, Artificial Sequence
  Synthetic oligonucleotide
cuggaauguuuauacuuugauaagaug

SEQ ID NO: 6583 - RNA, 27 nt, Artificial Sequence
  Synthetic oligonucleotide
acuggaauguuuauacuuugauaagau

SEQ ID NO: 6584 - RNA, 27 nt, Artificial Sequence
  Synthetic oligonucleotide
uacuggaauguuuauacuuugauaaga

SEQ ID NO: 6585 - RNA, 27 nt, Artificial Sequence
  Synthetic oligonucleotide
uuacuggaauguuuauacuuugauaag

SEQ ID NO: 6586 - RNA, 27 nt, Artificial Sequence
  Synthetic oligonucleotide
guuacuggaauguuuauacuuugauaa

SEQ ID NO: 6587 - RNA, 27 nt, Artificial Sequence
  Synthetic oligonucleotide
uguuacuggaauguuuauacuuugaua

SEQ ID NO: 6588 - RNA, 27 nt, Artificial Sequence
  Synthetic oligonucleotide
guguuacuggaauguuuauacuuugau

SEQ ID NO: 6589 - RNA, 27 nt, Artificial Sequence
  Synthetic oligonucleotide
gucgggaugaaggaaccauguucugug

SEQ ID NO: 6590 - RNA, 27 nt, Artificial Sequence
  Synthetic oligonucleotide
agucgggaugaaggaaccauguucugu

SEQ ID NO: 6591 - RNA, 27 nt, Artificial Sequence
  Synthetic oligonucleotide
aagucgggaugaaggaaccauguucug

SEQ ID NO: 6592 - RNA, 27 nt, Artificial Sequence
  Synthetic oligonucleotide
gaagucgggaugaaggaaccauguucu

SEQ ID NO: 6593 - RNA, 27 nt, Artificial Sequence
  Synthetic oligonucleotide
agaagucgggaugaaggaaccauguuc

SEQ ID NO: 6594 - RNA, 27 nt, Artificial Sequence
  Synthetic oligonucleotide
cagaagucgggaugaaggaaccauguu

SEQ ID NO: 6595 - RNA, 27 nt, Artificial Sequence
  Synthetic oligonucleotide
ccagaagucgggaugaaggaaccaugu

SEQ ID NO: 6596 - RNA, 27 nt, Artificial Sequence
  Synthetic oligonucleotide
accagaagucgggaugaaggaaccaug

SEQ ID NO: 6597 - RNA, 27 nt, Artificial Sequence
  Synthetic oligonucleotide
cuccugugacgauguaauagaccagaa

SEQ ID NO: 6598 - RNA, 27 nt, Artificial Sequence
  Synthetic oligonucleotide
ucuccugugacgauguaauagaccaga

SEQ ID NO: 6599 - RNA, 27 nt, Artificial Sequence
  Synthetic oligonucleotide
uucuccugugacgauguaauagaccag

SEQ ID NO: 6600 - RNA, 27 nt, Artificial Sequence
  Synthetic oligonucleotide
guucuccugugacgauguaauagacca

SEQ ID NO: 6601 - RNA, 27 nt, Artificial Sequence
  Synthetic oligonucleotide
uguucuccugugacgauguaauagacc

SEQ ID NO: 6602 - RNA, 27 nt, Artificial Sequence
  Synthetic oligonucleotide
cuguucuccugugacgauguaauagac

SEQ ID NO: 6603 - RNA, 27 nt, Artificial Sequence
  Synthetic oligonucleotide
ucuguucuccugugacgauguaauaga

SEQ ID NO: 6604 - RNA, 27 nt, Artificial Sequence
  Synthetic oligonucleotide
gucuguucuccugugacgauguaauag

SEQ ID NO: 6605 - RNA, 27 nt, Artificial Sequence
  Synthetic oligonucleotide
aaucagacacuaauucugcugucuguu

SEQ ID NO: 6606 - RNA, 27 nt, Artificial Sequence
  Synthetic oligonucleotide
gaaucagacacuaauucugcugucugu

SEQ ID NO: 6607 - RNA, 27 nt, Artificial Sequence
  Synthetic oligonucleotide
ugaaucagacacuaauucugcugucug

SEQ ID NO: 6608 - RNA, 27 nt, Artificial Sequence
  Synthetic oligonucleotide
cugaaucagacacuaauucugcugucu

SEQ ID NO: 6609 - RNA, 27 nt, Artificial Sequence
  Synthetic oligonucleotide
acugaaucagacacuaauucugcuguc

SEQ ID NO: 6610 - RNA, 27 nt, Artificial Sequence
  Synthetic oligonucleotide
gacugaaucagacacuaauucugcugu

SEQ ID NO: 6611 - RNA, 27 nt, Artificial Sequence
  Synthetic oligonucleotide
agacugaaucagacacuaauucugcug

SEQ ID NO: 6612 - RNA, 27 nt, Artificial Sequence
  Synthetic oligonucleotide
cagacugaaucagacacuaauucugcu

SEQ ID NO: 6613 - RNA, 27 nt, Artificial Sequence
  Synthetic oligonucleotide
ccagacugaaucagacacuaauucugc

SEQ ID NO: 6614 - RNA, 27 nt, Artificial Sequence
  Synthetic oligonucleotide
accagacugaaucagacacuaauucug

SEQ ID NO: 6615 - RNA, 27 nt, Artificial Sequence
  Synthetic oligonucleotide
aaccagacugaaucagacacuaauucu

SEQ ID NO: 6616 - RNA, 27 nt, Artificial Sequence
  Synthetic oligonucleotide
uaaccagacugaaucagacacuaauuc

SEQ ID NO: 6617 - RNA, 27 nt, Artificial Sequence
  Synthetic oligonucleotide
uuaaccagacugaaucagacacuaauu

SEQ ID NO: 6618 - RNA, 27 nt, Artificial Sequence
  Synthetic oligonucleotide
uuuaaccagacugaaucagacacuaau

SEQ ID NO: 6619 - RNA, 27 nt, Artificial Sequence
  Synthetic oligonucleotide
auuuaaccagacugaaucagacacuaa

SEQ ID NO: 6620 - RNA, 27 nt, Artificial Sequence
  Synthetic oligonucleotide
uauuuaaccagacugaaucagacacua

SEQ ID NO: 6621 - RNA, 27 nt, Artificial Sequence
  Synthetic oligonucleotide
auauuuaaccagacugaaucagacacu

SEQ ID NO: 6622 - RNA, 27 nt, Artificial Sequence
  Synthetic oligonucleotide
caauauuuaaccagacugaaucagaca

SEQ ID NO: 6623 - RNA, 27 nt, Artificial Sequence
  Synthetic oligonucleotide
uucuucaauauuuaaccagacugaauc

SEQ ID NO: 6624 - RNA, 27 nt, Artificial Sequence
  Synthetic oligonucleotide
gccacauuuuucuucaauauuuaacca

SEQ ID NO: 6625 - RNA, 27 nt, Artificial Sequence
  Synthetic oligonucleotide
ugccacauuuuucuucaauauuuaacc

SEQ ID NO: 6626 - RNA, 27 nt, Artificial Sequence
  Synthetic oligonucleotide
uugccacauuuuucuucaauauuuaac

SEQ ID NO: 6627 - RNA, 27 nt, Artificial Sequence
  Synthetic oligonucleotide
guugccacauuuuucuucaauauuuaa

SEQ ID NO: 6628 - RNA, 27 nt, Artificial Sequence
  Synthetic oligonucleotide
gguugccacauuuuucuucaauauuua

SEQ ID NO: 6629 - RNA, 27 nt, Artificial Sequence
  Synthetic oligonucleotide
ugguugccacauuuuucuucaauauuu

SEQ ID NO: 6630 - RNA, 27 nt, Artificial Sequence
  Synthetic oligonucleotide
cugguugccacauuuuucuucaauauu

SEQ ID NO: 6631 - RNA, 27 nt, Artificial Sequence
  Synthetic oligonucleotide
gcugguugccacauuuuucuucaauau

SEQ ID NO: 6632 - RNA, 27 nt, Artificial Sequence
  Synthetic oligonucleotide
agcugguugccacauuuuucuucaaua

SEQ ID NO: 6633 - RNA, 27 nt, Artificial Sequence
  Synthetic oligonucleotide
gagcugguugccacauuuuucuucaau

SEQ ID NO: 6634 - RNA, 27 nt, Artificial Sequence
  Synthetic oligonucleotide
ggagcugguugccacauuuuucuucaa

SEQ ID NO: 6635 - RNA, 27 nt, Artificial Sequence
  Synthetic oligonucleotide
uggagcugguugccacauuuuucuuca

SEQ ID NO: 6636 - RNA, 27 nt, Artificial Sequence
  Synthetic oligonucleotide
cuggagcugguugccacauuuuucuuc

SEQ ID NO: 6637 - RNA, 27 nt, Artificial Sequence
  Synthetic oligonucleotide
ccuggagcugguugccacauuuuucuu

SEQ ID NO: 6638 - RNA, 27 nt, Artificial Sequence
  Synthetic oligonucleotide
accuggagcugguugccacauuuuucu

SEQ ID NO: 6639 - RNA, 27 nt, Artificial Sequence
  Synthetic oligonucleotide
aaccuggagcugguugccacauuuuuc

SEQ ID NO: 6640 - RNA, 27 nt, Artificial Sequence
  Synthetic oligonucleotide
gaaccuggagcugguugccacauuuuu

SEQ ID NO: 6641 - RNA, 27 nt, Artificial Sequence
  Synthetic oligonucleotide
ugaaccuggagcugguugccacauuuu

SEQ ID NO: 6642 - RNA, 27 nt, Artificial Sequence
  Synthetic oligonucleotide
augaaccuggagcugguugccacauuu

SEQ ID NO: 6643 - RNA, 27 nt, Artificial Sequence
  Synthetic oligonucleotide
cagaugaaccuggagcugguugccaca

SEQ ID NO: 6644 - RNA, 27 nt, Artificial Sequence
  Synthetic oligonucleotide
acagaugaaccuggagcugguugccac

SEQ ID NO: 6645 - RNA, 27 nt, Artificial Sequence
  Synthetic oligonucleotide
gacagaugaaccuggagcugguugcca

SEQ ID NO: 6646 - RNA, 27 nt, Artificial Sequence
  Synthetic oligonucleotide
agacagaugaaccuggagcugguugcc

SEQ ID NO: 6647 - RNA, 27 nt, Artificial Sequence
  Synthetic oligonucleotide
gagacagaugaaccuggagcugguugc

SEQ ID NO: 6648 - RNA, 27 nt, Artificial Sequence
  Synthetic oligonucleotide
ggagacagaugaaccuggagcugguug

SEQ ID NO: 6649 - RNA, 27 nt, Artificial Sequence
  Synthetic oligonucleotide
aggagacagaugaaccuggagcugguu

SEQ ID NO: 6650 - RNA, 27 nt, Artificial Sequence
  Synthetic oligonucleotide
caggagacagaugaaccuggagcuggu

SEQ ID NO: 6651 - RNA, 27 nt, Artificial Sequence
  Synthetic oligonucleotide
ucaggagacagaugaaccuggagcugg

SEQ ID NO: 6652 - RNA, 27 nt, Artificial Sequence
  Synthetic oligonucleotide
aucaggagacagaugaaccuggagcug

SEQ ID NO: 6653 - RNA, 27 nt, Artificial Sequence
  Synthetic oligonucleotide
caucaggagacagaugaaccuggagcu

SEQ ID NO: 6654 - RNA, 27 nt, Artificial Sequence
  Synthetic oligonucleotide
gcaucaggagacagaugaaccuggagc

SEQ ID NO: 6655 - RNA, 27 nt, Artificial Sequence
  Synthetic oligonucleotide
ugcaucaggagacagaugaaccuggag

SEQ ID NO: 6656 - RNA, 27 nt, Artificial Sequence
  Synthetic oligonucleotide
cugcaucaggagacagaugaaccugga

SEQ ID NO: 6657 - RNA, 27 nt, Artificial Sequence
  Synthetic oligonucleotide
ucugcaucaggagacagaugaaccugg

SEQ ID NO: 6658 - RNA, 27 nt, Artificial Sequence
  Synthetic oligonucleotide
aucugcaucaggagacagaugaaccug

SEQ ID NO: 6659 - RNA, 27 nt, Artificial Sequence
  Synthetic oligonucleotide
caucugcaucaggagacagaugaaccu

SEQ ID NO: 6660 - RNA, 27 nt, Artificial Sequence
  Synthetic oligonucleotide
gcaucugcaucaggagacagaugaacc

SEQ ID NO: 6661 - RNA, 27 nt, Artificial Sequence
  Synthetic oligonucleotide
ugcaucugcaucaggagacagaugaac

SEQ ID NO: 6662 - RNA, 27 nt, Artificial Sequence
  Synthetic oligonucleotide
augcaucugcaucaggagacagaugaa

SEQ ID NO: 6663 - RNA, 27 nt, Artificial Sequence
  Synthetic oligonucleotide
uaugcaucugcaucaggagacagauga

SEQ ID NO: 6664 - RNA, 27 nt, Artificial Sequence
  Synthetic oligonucleotide
auaugcaucugcaucaggagacagaug

SEQ ID NO: 6665 - RNA, 27 nt, Artificial Sequence
  Synthetic oligonucleotide
cugcuaaugccacccaggaauccauuc

SEQ ID NO: 6666 - RNA, 27 nt, Artificial Sequence
  Synthetic oligonucleotide
gcugcuaaugccacccaggaauccauu

SEQ ID NO: 6667 - RNA, 27 nt, Artificial Sequence
  Synthetic oligonucleotide
ugcugcuaaugccacccaggaauccau

SEQ ID NO: 6668 - RNA, 27 nt, Artificial Sequence
  Synthetic oligonucleotide
acucuuuccaagggcuuuuuggcuccu

SEQ ID NO: 6669 - RNA, 27 nt, Artificial Sequence
  Synthetic oligonucleotide
uacucuuuccaagggcuuuuuggcucc

SEQ ID NO: 6670 - RNA, 27 nt, Artificial Sequence
  Synthetic oligonucleotide
auacucuuuccaagggcuuuuuggcuc

SEQ ID NO: 6671 - RNA, 27 nt, Artificial Sequence
  Synthetic oligonucleotide
aauacucuuuccaagggcuuuuuggcu

SEQ ID NO: 6672 - RNA, 27 nt, Artificial Sequence
  Synthetic oligonucleotide
aaauacucuuuccaagggcuuuuuggc

SEQ ID NO: 6673 - RNA, 27 nt, Artificial Sequence
  Synthetic oligonucleotide
gaaauacucuuuccaagggcuuuuugg

SEQ ID NO: 6674 - RNA, 27 nt, Artificial Sequence
  Synthetic oligonucleotide
ugaaauacucuuuccaagggcuuuuug

SEQ ID NO: 6675 - RNA, 27 nt, Artificial Sequence
  Synthetic oligonucleotide
uugaaauacucuuuccaagggcuuuuu

SEQ ID NO: 6676 - RNA, 27 nt, Artificial Sequence
  Synthetic oligonucleotide
auugaaauacucuuuccaagggcuuuu

SEQ ID NO: 6677 - RNA, 27 nt, Artificial Sequence
  Synthetic oligonucleotide
aauugaaauacucuuuccaagggcuuu

SEQ ID NO: 6678 - RNA, 27 nt, Artificial Sequence
  Synthetic oligonucleotide
gaauugaaauacucuuuccaagggcuu

SEQ ID NO: 6679 - RNA, 27 nt, Artificial Sequence
  Synthetic oligonucleotide
agaauugaaauacucuuuccaagggcu

SEQ ID NO: 6680 - RNA, 27 nt, Artificial Sequence
  Synthetic oligonucleotide
aagaauugaaauacucuuuccaagggc

SEQ ID NO: 6681 - RNA, 27 nt, Artificial Sequence
  Synthetic oligonucleotide
uaagaauugaaauacucuuuccaaggg

SEQ ID NO: 6682 - RNA, 27 nt, Artificial Sequence
  Synthetic oligonucleotide
cuaagaauugaaauacucuuuccaagg

SEQ ID NO: 6683 - RNA, 27 nt, Artificial Sequence
  Synthetic oligonucleotide
ucuaagaauugaaauacucuuuccaag

SEQ ID NO: 6684 - RNA, 27 nt, Artificial Sequence
  Synthetic oligonucleotide
cucuaagaauugaaauacucuuuccaa

SEQ ID NO: 6685 - RNA, 27 nt, Artificial Sequence
  Synthetic oligonucleotide
ucucuaagaauugaaauacucuuucca

SEQ ID NO: 6686 - RNA, 27 nt, Artificial Sequence
  Synthetic oligonucleotide
uucucuaagaauugaaauacucuuucc

SEQ ID NO: 6687 - RNA, 27 nt, Artificial Sequence
  Synthetic oligonucleotide
cuucucuaagaauugaaauacucuuuc

SEQ ID NO: 6688 - RNA, 27 nt, Artificial Sequence
  Synthetic oligonucleotide
ucuucucuaagaauugaaauacucuuu

SEQ ID NO: 6689 - RNA, 27 nt, Artificial Sequence
  Synthetic oligonucleotide
cucuucucuaagaauugaaauacucuu

SEQ ID NO: 6690 - RNA, 27 nt, Artificial Sequence
  Synthetic oligonucleotide
acucuucucuaagaauugaaauacucu

SEQ ID NO: 6691 - RNA, 27 nt, Artificial Sequence
  Synthetic oligonucleotide
cacucuucucuaagaauugaaauacuc

SEQ ID NO: 6692 - RNA, 27 nt, Artificial Sequence
  Synthetic oligonucleotide
ucacucuucucuaagaauugaaauacu

SEQ ID NO: 6693 - RNA, 27 nt, Artificial Sequence
  Synthetic oligonucleotide
aucacucuucucuaagaauugaaauac

SEQ ID NO: 6694 - RNA, 27 nt, Artificial Sequence
  Synthetic oligonucleotide
gaucacucuucucuaagaauugaaaua

SEQ ID NO: 6695 - RNA, 27 nt, Artificial Sequence
  Synthetic oligonucleotide
agaucacucuucucuaagaauugaaau

SEQ ID NO: 6696 - RNA, 27 nt, Artificial Sequence
  Synthetic oligonucleotide
cagaucacucuucucuaagaauugaaa

SEQ ID NO: 6697 - RNA, 27 nt, Artificial Sequence
  Synthetic oligonucleotide
ccagaucacucuucucuaagaauugaa

SEQ ID NO: 6698 - RNA, 27 nt, Artificial Sequence
  Synthetic oligonucleotide
cccagaucacucuucucuaagaauuga

SEQ ID NO: 6699 - RNA, 27 nt, Artificial Sequence
  Synthetic oligonucleotide
gcccagaucacucuucucuaagaauug

SEQ ID NO: 6700 - RNA, 27 nt, Artificial Sequence
  Synthetic oligonucleotide
agcccagaucacucuucucuaagaauu

SEQ ID NO: 6701 - RNA, 27 nt, Artificial Sequence
  Synthetic oligonucleotide
acagcccagaucacucuucucuaagaa

SEQ ID NO: 6702 - RNA, 27 nt, Artificial Sequence
  Synthetic oligonucleotide
cacagcccagaucacucuucucuaaga

SEQ ID NO: 6703 - RNA, 27 nt, Artificial Sequence
  Synthetic oligonucleotide
cccacagcccagaucacucuucucuaa

SEQ ID NO: 6704 - RNA, 27 nt, Artificial Sequence
  Synthetic oligonucleotide
auuguugaggccaccaccugccccaca

SEQ ID NO: 6705 - RNA, 27 nt, Artificial Sequence
  Synthetic oligonucleotide
uggcauuguugaggccaccaccugccc

SEQ ID NO: 6706 - RNA, 27 nt, Artificial Sequence
  Synthetic oligonucleotide
uuggcauuguugaggccaccaccugcc

SEQ ID NO: 6707 - RNA, 27 nt, Artificial Sequence
  Synthetic oligonucleotide
auuggcauuguugaggccaccaccugc

SEQ ID NO: 6708 - RNA, 27 nt, Artificial Sequence
  Synthetic oligonucleotide
cauuggcauuguugaggccaccaccug

SEQ ID NO: 6709 - RNA, 27 nt, Artificial Sequence
  Synthetic oligonucleotide
acauuggcauuguugaggccaccaccu

SEQ ID NO: 6710 - RNA, 27 nt, Artificial Sequence
  Synthetic oligonucleotide
cacauuggcauuguugaggccaccacc

SEQ ID NO: 6711 - RNA, 27 nt, Artificial Sequence
  Synthetic oligonucleotide
gaagguaaguccagcuagguggaacac

SEQ ID NO: 6712 - RNA, 27 nt, Artificial Sequence
  Synthetic oligonucleotide
ggaagguaaguccagcuagguggaaca

SEQ ID NO: 6713 - RNA, 27 nt, Artificial Sequence
  Synthetic oligonucleotide
aggaagguaaguccagcuagguggaac

SEQ ID NO: 6714 - RNA, 27 nt, Artificial Sequence
  Synthetic oligonucleotide
gaggaagguaaguccagcuagguggaa

SEQ ID NO: 6715 - RNA, 27 nt, Artificial Sequence
  Synthetic oligonucleotide
ugaggaagguaaguccagcuaggugga

SEQ ID NO: 6716 - RNA, 27 nt, Artificial Sequence
  Synthetic oligonucleotide
gugaggaagguaaguccagcuaggugg

SEQ ID NO: 6717 - RNA, 27 nt, Artificial Sequence
  Synthetic oligonucleotide
agugaggaagguaaguccagcuaggug

SEQ ID NO: 6718 - RNA, 27 nt, Artificial Sequence
  Synthetic oligonucleotide
uagugaggaagguaaguccagcuaggu

SEQ ID NO: 6719 - RNA, 27 nt, Artificial Sequence
  Synthetic oligonucleotide
uuagugaggaagguaaguccagcuagg

SEQ ID NO: 6720 - RNA, 27 nt, Artificial Sequence
  Synthetic oligonucleotide
auuagugaggaagguaaguccagcuag

SEQ ID NO: 6721 - RNA, 27 nt, Artificial Sequence
  Synthetic oligonucleotide
cauuagugaggaagguaaguccagcua

SEQ ID NO: 6722 - RNA, 27 nt, Artificial Sequence
  Synthetic oligonucleotide
gcauuagugaggaagguaaguccagcu

SEQ ID NO: 6723 - RNA, 27 nt, Artificial Sequence
  Synthetic oligonucleotide
ugcauuagugaggaagguaaguccagc

SEQ ID NO: 6724 - RNA, 27 nt, Artificial Sequence
  Synthetic oligonucleotide
uugcauuagugaggaagguaaguccag

SEQ ID NO: 6725 - RNA, 27 nt, Artificial Sequence
  Synthetic oligonucleotide
uuugcauuagugaggaagguaagucca

SEQ ID NO: 6726 - RNA, 27 nt, Artificial Sequence
  Synthetic oligonucleotide
auuugcauuagugaggaagguaagucc

SEQ ID NO: 6727 - RNA, 27 nt, Artificial Sequence
  Synthetic oligonucleotide
cauuugcauuagugaggaagguaaguc

SEQ ID NO: 6728 - RNA, 27 nt, Artificial Sequence
  Synthetic oligonucleotide
gcauuugcauuagugaggaagguaagu

SEQ ID NO: 6729 - RNA, 27 nt, Artificial Sequence
  Synthetic oligonucleotide
ugcauuugcauuagugaggaagguaag

SEQ ID NO: 6730 - RNA, 27 nt, Artificial Sequence
  Synthetic oligonucleotide
cugcauuugcauuagugaggaagguaa

SEQ ID NO: 6731 - RNA, 27 nt, Artificial Sequence
  Synthetic oligonucleotide
ucugcauuugcauuagugaggaaggua

SEQ ID NO: 6732 - RNA, 27 nt, Artificial Sequence
  Synthetic oligonucleotide
aucugcauuugcauuagugaggaaggu

SEQ ID NO: 6733 - RNA, 27 nt, Artificial Sequence
  Synthetic oligonucleotide
caucugcauuugcauuagugaggaagg

SEQ ID NO: 6734 - RNA, 27 nt, Artificial Sequence
  Synthetic oligonucleotide
ucaucugcauuugcauuagugaggaag

SEQ ID NO: 6735 - RNA, 27 nt, Artificial Sequence
  Synthetic oligonucleotide
gucaucugcauuugcauuagugaggaa

SEQ ID NO: 6736 - RNA, 27 nt, Artificial Sequence
  Synthetic oligonucleotide
agucaucugcauuugcauuagugagga

SEQ ID NO: 6737 - RNA, 27 nt, Artificial Sequence
  Synthetic oligonucleotide
gagucaucugcauuugcauuagugagg

SEQ ID NO: 6738 - RNA, 27 nt, Artificial Sequence
  Synthetic oligonucleotide
ggagucaucugcauuugcauuagugag

SEQ ID NO: 6739 - RNA, 27 nt, Artificial Sequence
  Synthetic oligonucleotide
gggagucaucugcauuugcauuaguga

SEQ ID NO: 6740 - RNA, 27 nt, Artificial Sequence
  Synthetic oligonucleotide
ugggagucaucugcauuugcauuagug

SEQ ID NO: 6741 - RNA, 27 nt, Artificial Sequence
  Synthetic oligonucleotide
uugggagucaucugcauuugcauuagu

SEQ ID NO: 6742 - RNA, 27 nt, Artificial Sequence
  Synthetic oligonucleotide
cuugggagucaucugcauuugcauuag

SEQ ID NO: 6743 - RNA, 27 nt, Artificial Sequence
  Synthetic oligonucleotide
ucuugggagucaucugcauuugcauua

SEQ ID NO: 6744 - RNA, 27 nt, Artificial Sequence
  Synthetic oligonucleotide
uucuugggagucaucugcauuugcauu

SEQ ID NO: 6745 - RNA, 27 nt, Artificial Sequence
  Synthetic oligonucleotide
uuucuugggagucaucugcauuugcau

SEQ ID NO: 6746 - RNA, 27 nt, Artificial Sequence
  Synthetic oligonucleotide
uuuucuugggagucaucugcauuugca

SEQ ID NO: 6747 - RNA, 27 nt, Artificial Sequence
  Synthetic oligonucleotide
auuuucuugggagucaucugcauuugc

SEQ ID NO: 6748 - RNA, 27 nt, Artificial Sequence
  Synthetic oligonucleotide
cauuuucuugggagucaucugcauuug

SEQ ID NO: 6749 - RNA, 27 nt, Artificial Sequence
  Synthetic oligonucleotide
ucauuuucuugggagucaucugcauuu

SEQ ID NO: 6750 - RNA, 27 nt, Artificial Sequence
  Synthetic oligonucleotide
aucauuuucuugggagucaucugcauu

SEQ ID NO: 6751 - RNA, 27 nt, Artificial Sequence
  Synthetic oligonucleotide
caucauuuucuugggagucaucugcau

SEQ ID NO: 6752 - RNA, 27 nt, Artificial Sequence
  Synthetic oligonucleotide
ucaucauuuucuugggagucaucugca

SEQ ID NO: 6753 - RNA, 27 nt, Artificial Sequence
  Synthetic oligonucleotide
uucaucauuuucuugggagucaucugc

SEQ ID NO: 6754 - RNA, 27 nt, Artificial Sequence
  Synthetic oligonucleotide
guucaucauuuucuugggagucaucug

SEQ ID NO: 6755 - RNA, 27 nt, Artificial Sequence
  Synthetic oligonucleotide
gguucaucauuuucuugggagucaucu

SEQ ID NO: 6756 - RNA, 27 nt, Artificial Sequence
  Synthetic oligonucleotide
agguucaucauuuucuugggagucauc

SEQ ID NO: 6757 - RNA, 27 nt, Artificial Sequence
  Synthetic oligonucleotide
aagguucaucauuuucuugggagucau

SEQ ID NO: 6758 - RNA, 27 nt, Artificial Sequence
  Synthetic oligonucleotide
caagguucaucauuuucuugggaguca

SEQ ID NO: 6759 - RNA, 27 nt, Artificial Sequence
  Synthetic oligonucleotide
acaagguucaucauuuucuugggaguc

SEQ ID NO: 6760 - RNA, 27 nt, Artificial Sequence
  Synthetic oligonucleotide
uacaagguucaucauuuucuugggagu

SEQ ID NO: 6761 - RNA, 27 nt, Artificial Sequence
  Synthetic oligonucleotide
uuacaagguucaucauuuucuugggag

SEQ ID NO: 6762 - RNA, 27 nt, Artificial Sequence
  Synthetic oligonucleotide
uuuacaagguucaucauuuucuuggga

SEQ ID NO: 6763 - RNA, 27 nt, Artificial Sequence
  Synthetic oligonucleotide
cuuuacaagguucaucauuuucuuggg

SEQ ID NO: 6764 - RNA, 27 nt, Artificial Sequence
  Synthetic oligonucleotide
ucuuuacaagguucaucauuuucuugg

SEQ ID NO: 6765 - RNA, 27 nt, Artificial Sequence
  Synthetic oligonucleotide
uuucuuuacaagguucaucauuuucuu

SEQ ID NO: 6766 - RNA, 27 nt, Artificial Sequence
  Synthetic oligonucleotide
auuucuuuacaagguucaucauuuucu

SEQ ID NO: 6767 - RNA, 27 nt, Artificial Sequence
  Synthetic oligonucleotide
aauuucuuuacaagguucaucauuuuc

SEQ ID NO: 6768 - RNA, 27 nt, Artificial Sequence
  Synthetic oligonucleotide
gaauuucuuuacaagguucaucauuuu

SEQ ID NO: 6769 - RNA, 27 nt, Artificial Sequence
  Synthetic oligonucleotide
gagaauuucuuuacaagguucaucauu

SEQ ID NO: 6770 - RNA, 27 nt, Artificial Sequence
  Synthetic oligonucleotide
ccugagaauuucuuuacaagguucauc

SEQ ID NO: 6771 - RNA, 27 nt, Artificial Sequence
  Synthetic oligonucleotide
uuagcagcuauuucuucuaucuucuuu

SEQ ID NO: 6772 - RNA, 27 nt, Artificial Sequence
  Synthetic oligonucleotide
uuuagcagcuauuucuucuaucuucuu

SEQ ID NO: 6773 - RNA, 27 nt, Artificial Sequence
  Synthetic oligonucleotide
auuuagcagcuauuucuucuaucuucu

SEQ ID NO: 6774 - RNA, 27 nt, Artificial Sequence
  Synthetic oligonucleotide
uauuuagcagcuauuucuucuaucuuc

SEQ ID NO: 6775 - RNA, 27 nt, Artificial Sequence
  Synthetic oligonucleotide
auauuuagcagcuauuucuucuaucuu

SEQ ID NO: 6776 - RNA, 27 nt, Artificial Sequence
  Synthetic oligonucleotide
uauauuuagcagcuauuucuucuaucu

SEQ ID NO: 6777 - RNA, 27 nt, Artificial Sequence
  Synthetic oligonucleotide
uuauauuuagcagcuauuucuucuauc

SEQ ID NO: 6778 - RNA, 27 nt, Artificial Sequence
  Synthetic oligonucleotide
uuuauauuuagcagcuauuucuucuau

SEQ ID NO: 6779 - RNA, 27 nt, Artificial Sequence
  Synthetic oligonucleotide
guuuauauuuagcagcuauuucuucua

SEQ ID NO: 6780 - RNA, 27 nt, Artificial Sequence
  Synthetic oligonucleotide
uguuuauauuuagcagcuauuucuucu

SEQ ID NO: 6781 - RNA, 27 nt, Artificial Sequence
  Synthetic oligonucleotide
auguuuauauuuagcagcuauuucuuc

SEQ ID NO: 6782 - RNA, 27 nt, Artificial Sequence
  Synthetic oligonucleotide
aauguuuauauuuagcagcuauuucuu

SEQ ID NO: 6783 - RNA, 27 nt, Artificial Sequence
  Synthetic oligonucleotide
gaauguuuauauuuagcagcuauuucu

SEQ ID NO: 6784 - RNA, 27 nt, Artificial Sequence
  Synthetic oligonucleotide
ugaauguuuauauuuagcagcuauuuc

SEQ ID NO: 6785 - RNA, 27 nt, Artificial Sequence
  Synthetic oligonucleotide
cugaauguuuauauuuagcagcuauuu

SEQ ID NO: 6786 - RNA, 27 nt, Artificial Sequence
  Synthetic oligonucleotide
acugaauguuuauauuuagcagcuauu

SEQ ID NO: 6787 - RNA, 27 nt, Artificial Sequence
  Synthetic oligonucleotide
uacugaauguuuauauuuagcagcuau

SEQ ID NO: 6788 - RNA, 27 nt, Artificial Sequence
  Synthetic oligonucleotide
cuacugaauguuuauauuuagcagcua

SEQ ID NO: 6789 - RNA, 27 nt, Artificial Sequence
  Synthetic oligonucleotide
ccaucguaacaacauuucuucacuacu

SEQ ID NO: 6790 - RNA, 27 nt, Artificial Sequence
  Synthetic oligonucleotide
uccaucguaacaacauuucuucacuac

SEQ ID NO: 6791 - RNA, 27 nt, Artificial Sequence
  Synthetic oligonucleotide
cuccaucguaacaacauuucuucacua

SEQ ID NO: 6792 - RNA, 27 nt, Artificial Sequence
  Synthetic oligonucleotide
gcuccaucguaacaacauuucuucacu

SEQ ID NO: 6793 - RNA, 27 nt, Artificial Sequence
  Synthetic oligonucleotide
ggcuccaucguaacaacauuucuucac

SEQ ID NO: 6794 - RNA, 27 nt, Artificial Sequence
  Synthetic oligonucleotide
aggcuccaucguaacaacauuucuuca

SEQ ID NO: 6795 - RNA, 27 nt, Artificial Sequence
  Synthetic oligonucleotide
caggcuccaucguaacaacauuucuuc

SEQ ID NO: 6796 - RNA, 27 nt, Artificial Sequence
  Synthetic oligonucleotide
gcaggcuccaucguaacaacauuucuu

SEQ ID NO: 6797 - RNA, 27 nt, Artificial Sequence
  Synthetic oligonucleotide
cgcaggcuccaucguaacaacauuucu

SEQ ID NO: 6798 - RNA, 27 nt, Artificial Sequence
  Synthetic oligonucleotide
gcucgcugcucacagguuucaucauua

SEQ ID NO: 6799 - RNA, 27 nt, Artificial Sequence
  Synthetic oligonucleotide
agcucgcugcucacagguuucaucauu

SEQ ID NO: 6800 - RNA, 27 nt, Artificial Sequence
  Synthetic oligonucleotide
cagcucgcugcucacagguuucaucau

SEQ ID NO: 6801 - RNA, 27 nt, Artificial Sequence
  Synthetic oligonucleotide
gcagcucgcugcucacagguuucauca

SEQ ID NO: 6802 - RNA, 27 nt, Artificial Sequence
  Synthetic oligonucleotide
ugcagcucgcugcucacagguuucauc

SEQ ID NO: 6803 - RNA, 27 nt, Artificial Sequence
  Synthetic oligonucleotide
gugcagcucgcugcucacagguuucau

SEQ ID NO: 6804 - RNA, 27 nt, Artificial Sequence
  Synthetic oligonucleotide
cgugcagcucgcugcucacagguuuca

SEQ ID NO: 6805 - RNA, 27 nt, Artificial Sequence
  Synthetic oligonucleotide
auccgugcagcucgcugcucacagguu

SEQ ID NO: 6806 - RNA, 27 nt, Artificial Sequence
  Synthetic oligonucleotide
aauccgugcagcucgcugcucacaggu

SEQ ID NO: 6807 - RNA, 27 nt, Artificial Sequence
  Synthetic oligonucleotide
uaauccgugcagcucgcugcucacagg

SEQ ID NO: 6808 - RNA, 27 nt, Artificial Sequence
  Synthetic oligonucleotide
cuaauccgugcagcucgcugcucacag

SEQ ID NO: 6809 - RNA, 27 nt, Artificial Sequence
  Synthetic oligonucleotide
acuaauccgugcagcucgcugcucaca

SEQ ID NO: 6810 - RNA, 27 nt, Artificial Sequence
  Synthetic oligonucleotide
aacuaauccgugcagcucgcugcucac

SEQ ID NO: 6811 - RNA, 27 nt, Artificial Sequence
  Synthetic oligonucleotide
aaacuaauccgugcagcucgcugcuca

SEQ ID NO: 6812 - RNA, 27 nt, Artificial Sequence
  Synthetic oligonucleotide
uaaacuaauccgugcagcucgcugcuc

SEQ ID NO: 6813 - RNA, 27 nt, Artificial Sequence
  Synthetic oligonucleotide
cuaaacuaauccgugcagcucgcugcu

SEQ ID NO: 6814 - RNA, 27 nt, Artificial Sequence
  Synthetic oligonucleotide
ccuaaacuaauccgugcagcucgcugc

SEQ ID NO: 6815 - RNA, 27 nt, Artificial Sequence
  Synthetic oligonucleotide
cccuaaacuaauccgugcagcucgcug

SEQ ID NO: 6816 - RNA, 27 nt, Artificial Sequence
  Synthetic oligonucleotide
uagcacggagcuggcuugcgacgacac

SEQ ID NO: 6817 - RNA, 27 nt, Artificial Sequence
  Synthetic oligonucleotide
uuagcacggagcuggcuugcgacgaca

SEQ ID NO: 6818 - RNA, 27 nt, Artificial Sequence
  Synthetic oligonucleotide
auuagcacggagcuggcuugcgacgac

SEQ ID NO: 6819 - RNA, 27 nt, Artificial Sequence
  Synthetic oligonucleotide
uauuagcacggagcuggcuugcgacga

SEQ ID NO: 6820 - RNA, 27 nt, Artificial Sequence
  Synthetic oligonucleotide
auauuagcacggagcuggcuugcgacg

SEQ ID NO: 6821 - RNA, 27 nt, Artificial Sequence
  Synthetic oligonucleotide
gauauuagcacggagcuggcuugcgac

SEQ ID NO: 6822 - RNA, 27 nt, Artificial Sequence
  Synthetic oligonucleotide
agauauuagcacggagcuggcuugcga

SEQ ID NO: 6823 - RNA, 27 nt, Artificial Sequence
  Synthetic oligonucleotide
gagauauuagcacggagcuggcuugcg

SEQ ID NO: 6824 - RNA, 27 nt, Artificial Sequence
  Synthetic oligonucleotide
agagauauuagcacggagcuggcuugc

SEQ ID NO: 6825 - RNA, 27 nt, Artificial Sequence
  Synthetic oligonucleotide
gagagauauuagcacggagcuggcuug

SEQ ID NO: 6826 - RNA, 27 nt, Artificial Sequence
  Synthetic oligonucleotide
gcuuacugguaacagggucuucaugug

SEQ ID NO: 6827 - RNA, 27 nt, Artificial Sequence
  Synthetic oligonucleotide
ugcuuacugguaacagggucuucaugu

SEQ ID NO: 6828 - RNA, 27 nt, Artificial Sequence
  Synthetic oligonucleotide
uugcuuacugguaacagggucuucaug

SEQ ID NO: 6829 - RNA, 27 nt, Artificial Sequence
  Synthetic oligonucleotide
gcuugcuuacugguaacagggucuuca

SEQ ID NO: 6830 - RNA, 27 nt, Artificial Sequence
  Synthetic oligonucleotide
ggcuugcuuacugguaacagggucuuc

SEQ ID NO: 6831 - RNA, 27 nt, Artificial Sequence
  Synthetic oligonucleotide
uggcuugcuuacugguaacagggucuu

SEQ ID NO: 6832 - RNA, 27 nt, Artificial Sequence
  Synthetic oligonucleotide
cuggcuugcuuacugguaacagggucu

SEQ ID NO: 6833 - RNA, 27 nt, Artificial Sequence
  Synthetic oligonucleotide
ucuggcuugcuuacugguaacaggguc

SEQ ID NO: 6834 - RNA, 27 nt, Artificial Sequence
  Synthetic oligonucleotide
uucuggcuugcuuacugguaacagggu

SEQ ID NO: 6835 - RNA, 27 nt, Artificial Sequence
  Synthetic oligonucleotide
uuucuggcuugcuuacugguaacaggg

SEQ ID NO: 6836 - RNA, 27 nt, Artificial Sequence
  Synthetic oligonucleotide
auuucuggcuugcuuacugguaacagg

SEQ ID NO: 6837 - RNA, 27 nt, Artificial Sequence
  Synthetic oligonucleotide
aauuucuggcuugcuuacugguaacag

SEQ ID NO: 6838 - RNA, 27 nt, Artificial Sequence
  Synthetic oligonucleotide
gaauuucuggcuugcuuacugguaaca

SEQ ID NO: 6839 - RNA, 27 nt, Artificial Sequence
  Synthetic oligonucleotide
cgaauuucuggcuugcuuacugguaac

SEQ ID NO: 6840 - RNA, 27 nt, Artificial Sequence
  Synthetic oligonucleotide
ccgaauuucuggcuugcuuacugguaa

SEQ ID NO: 6841 - RNA, 27 nt, Artificial Sequence
  Synthetic oligonucleotide
uccgaauuucuggcuugcuuacuggua

SEQ ID NO: 6842 - RNA, 27 nt, Artificial Sequence
  Synthetic oligonucleotide
cuccgaauuucuggcuugcuuacuggu

SEQ ID NO: 6843 - RNA, 27 nt, Artificial Sequence
  Synthetic oligonucleotide
acuccgaauuucuggcuugcuuacugg

SEQ ID NO: 6844 - RNA, 27 nt, Artificial Sequence
  Synthetic oligonucleotide
aacuccgaauuucuggcuugcuuacug

SEQ ID NO: 6845 - RNA, 27 nt, Artificial Sequence
  Synthetic oligonucleotide
uaacuccgaauuucuggcuugcuuacu

SEQ ID NO: 6846 - RNA, 27 nt, Artificial Sequence
  Synthetic oligonucleotide
auaacuccgaauuucuggcuugcuuac

SEQ ID NO: 6847 - RNA, 27 nt, Artificial Sequence
  Synthetic oligonucleotide
aauaacuccgaauuucuggcuugcuua

SEQ ID NO: 6848 - RNA, 27 nt, Artificial Sequence
  Synthetic oligonucleotide
aaauaacuccgaauuucuggcuugcuu

SEQ ID NO: 6849 - RNA, 27 nt, Artificial Sequence
  Synthetic oligonucleotide
gaaaauaacuccgaauuucuggcuugc

SEQ ID NO: 6850 - RNA, 27 nt, Artificial Sequence
  Synthetic oligonucleotide
ggaaaauaacuccgaauuucuggcuug

SEQ ID NO: 6851 - RNA, 27 nt, Artificial Sequence
  Synthetic oligonucleotide
uggaaaauaacuccgaauuucuggcuu

SEQ ID NO: 6852 - RNA, 27 nt, Artificial Sequence
  Synthetic oligonucleotide
cuggaaaauaacuccgaauuucuggcu

SEQ ID NO: 6853 - RNA, 27 nt, Artificial Sequence
  Synthetic oligonucleotide
ucuggaaaauaacuccgaauuucuggc

SEQ ID NO: 6854 - RNA, 27 nt, Artificial Sequence
  Synthetic oligonucleotide
uucuggaaaauaacuccgaauuucugg

SEQ ID NO: 6855 - RNA, 27 nt, Artificial Sequence
  Synthetic oligonucleotide
uuucuggaaaauaacuccgaauuucug

SEQ ID NO: 6856 - RNA, 27 nt, Artificial Sequence
  Synthetic oligonucleotide
cuuucuggaaaauaacuccgaauuucu

SEQ ID NO: 6857 - RNA, 27 nt, Artificial Sequence
  Synthetic oligonucleotide
gcuuucuggaaaauaacuccgaauuuc

SEQ ID NO: 6858 - RNA, 27 nt, Artificial Sequence
  Synthetic oligonucleotide
agcuuucuggaaaauaacuccgaauuu

SEQ ID NO: 6859 - RNA, 27 nt, Artificial Sequence
  Synthetic oligonucleotide
cagcuuucuggaaaauaacuccgaauu

SEQ ID NO: 6860 - RNA, 27 nt, Artificial Sequence
  Synthetic oligonucleotide
ccagcuuucuggaaaauaacuccgaau

SEQ ID NO: 6861 - RNA, 27 nt, Artificial Sequence
  Synthetic oligonucleotide
accagcuuucuggaaaauaacuccgaa

SEQ ID NO: 6862 - RNA, 27 nt, Artificial Sequence
  Synthetic oligonucleotide
aaccagcuuucuggaaaauaacuccga

SEQ ID NO: 6863 - RNA, 27 nt, Artificial Sequence
  Synthetic oligonucleotide
caaccagcuuucuggaaaauaacuccg

SEQ ID NO: 6864 - RNA, 27 nt, Artificial Sequence
  Synthetic oligonucleotide
acaaccagcuuucuggaaaauaacucc

SEQ ID NO: 6865 - RNA, 27 nt, Artificial Sequence
  Synthetic oligonucleotide
cacaaccagcuuucuggaaaauaacuc

SEQ ID NO: 6866 - RNA, 27 nt, Artificial Sequence
  Synthetic oligonucleotide
ccacaaccagcuuucuggaaaauaacu

SEQ ID NO: 6867 - RNA, 27 nt, Artificial Sequence
  Synthetic oligonucleotide
cccacaaccagcuuucuggaaaauaac

SEQ ID NO: 6868 - RNA, 27 nt, Artificial Sequence
  Synthetic oligonucleotide
ucccacaaccagcuuucuggaaaauaa

SEQ ID NO: 6869 - RNA, 27 nt, Artificial Sequence
  Synthetic oligonucleotide
uucugggaacaagaugaacuucccaca

SEQ ID NO: 6870 - RNA, 27 nt, Artificial Sequence
  Synthetic oligonucleotide
cuucugggaacaagaugaacuucccac

SEQ ID NO: 6871 - RNA, 27 nt, Artificial Sequence
  Synthetic oligonucleotide
ucuucugggaacaagaugaacuuccca

SEQ ID NO: 6872 - RNA, 27 nt, Artificial Sequence
  Synthetic oligonucleotide
uucuucugggaacaagaugaacuuccc

SEQ ID NO: 6873 - RNA, 27 nt, Artificial Sequence
  Synthetic oligonucleotide
uuucuucugggaacaagaugaacuucc

SEQ ID NO: 6874 - RNA, 27 nt, Artificial Sequence
  Synthetic oligonucleotide
uuuucuucugggaacaagaugaacuuc

SEQ ID NO: 6875 - RNA, 27 nt, Artificial Sequence
  Synthetic oligonucleotide
guuuucuucugggaacaagaugaacuu

SEQ ID NO: 6876 - RNA, 27 nt, Artificial Sequence
  Synthetic oligonucleotide
uguuuucuucugggaacaagaugaacu

SEQ ID NO: 6877 - RNA, 27 nt, Artificial Sequence
  Synthetic oligonucleotide
cuguuuucuucugggaacaagaugaac

SEQ ID NO: 6878 - RNA, 27 nt, Artificial Sequence
  Synthetic oligonucleotide
acuguuuucuucugggaacaagaugaa

SEQ ID NO: 6879 - RNA, 27 nt, Artificial Sequence
  Synthetic oligonucleotide
aacuguuuucuucugggaacaagauga

SEQ ID NO: 6880 - RNA, 27 nt, Artificial Sequence
  Synthetic oligonucleotide
caacuguuuucuucugggaacaagaug

SEQ ID NO: 6881 - RNA, 27 nt, Artificial Sequence
  Synthetic oligonucleotide
gcaacuguuuucuucugggaacaagau

SEQ ID NO: 6882 - RNA, 27 nt, Artificial Sequence
  Synthetic oligonucleotide
ugcaacuguuuucuucugggaacaaga

SEQ ID NO: 6883 - RNA, 27 nt, Artificial Sequence
  Synthetic oligonucleotide
cugcaacuguuuucuucugggaacaag

SEQ ID NO: 6884 - RNA, 27 nt, Artificial Sequence
  Synthetic oligonucleotide
acugcaacuguuuucuucugggaacaa

SEQ ID NO: 6885 - RNA, 27 nt, Artificial Sequence
  Synthetic oligonucleotide
aacugcaacuguuuucuucugggaaca

SEQ ID NO: 6886 - RNA, 27 nt, Artificial Sequence
  Synthetic oligonucleotide
aaacugcaacuguuuucuucugggaac

SEQ ID NO: 6887 - RNA, 27 nt, Artificial Sequence
  Synthetic oligonucleotide
caaacugcaacuguuuucuucugggaa

SEQ ID NO: 6888 - RNA, 27 nt, Artificial Sequence
  Synthetic oligonucleotide
gcaaacugcaacuguuuucuucuggga

SEQ ID NO: 6889 - RNA, 27 nt, Artificial Sequence
  Synthetic oligonucleotide
ggcaaacugcaacuguuuucuucuggg

SEQ ID NO: 6890 - RNA, 27 nt, Artificial Sequence
  Synthetic oligonucleotide
gggcaaacugcaacuguuuucuucugg

SEQ ID NO: 6891 - RNA, 27 nt, Artificial Sequence
  Synthetic oligonucleotide
agggcaaacugcaacuguuuucuucug

SEQ ID NO: 6892 - RNA, 27 nt, Artificial Sequence
  Synthetic oligonucleotide
uagggcaaacugcaacuguuuucuucu

SEQ ID NO: 6893 - RNA, 27 nt, Artificial Sequence
  Synthetic oligonucleotide
guagggcaaacugcaacuguuuucuuc

SEQ ID NO: 6894 - RNA, 27 nt, Artificial Sequence
  Synthetic oligonucleotide
gguagggcaaacugcaacuguuuucuu

SEQ ID NO: 6895 - RNA, 27 nt, Artificial Sequence
  Synthetic oligonucleotide
agguagggcaaacugcaacuguuuucu

SEQ ID NO: 6896 - RNA, 27 nt, Artificial Sequence
  Synthetic oligonucleotide
cagguagggcaaacugcaacuguuuuc

SEQ ID NO: 6897 - RNA, 27 nt, Artificial Sequence
  Synthetic oligonucleotide
ucagguagggcaaacugcaacuguuuu

SEQ ID NO: 6898 - RNA, 27 nt, Artificial Sequence
  Synthetic oligonucleotide
aucagguagggcaaacugcaacuguuu

SEQ ID NO: 6899 - RNA, 27 nt, Artificial Sequence
  Synthetic oligonucleotide
aaucagguagggcaaacugcaacuguu

SEQ ID NO: 6900 - RNA, 27 nt, Artificial Sequence
  Synthetic oligonucleotide
gaaucagguagggcaaacugcaacugu

SEQ ID NO: 6901 - RNA, 27 nt, Artificial Sequence
  Synthetic oligonucleotide
agaaucagguagggcaaacugcaacug

SEQ ID NO: 6902 - RNA, 27 nt, Artificial Sequence
  Synthetic oligonucleotide
gagaaucagguagggcaaacugcaacu

SEQ ID NO: 6903 - RNA, 27 nt, Artificial Sequence
  Synthetic oligonucleotide
agagaaucagguagggcaaacugcaac

SEQ ID NO: 6904 - RNA, 27 nt, Artificial Sequence
  Synthetic oligonucleotide
uagagaaucagguagggcaaacugcaa

SEQ ID NO: 6905 - RNA, 27 nt, Artificial Sequence
  Synthetic oligonucleotide
uuagagaaucagguagggcaaacugca

SEQ ID NO: 6906 - RNA, 27 nt, Artificial Sequence
  Synthetic oligonucleotide
guuagagaaucagguagggcaaacugc

SEQ ID NO: 6907 - RNA, 27 nt, Artificial Sequence
  Synthetic oligonucleotide
gguuagagaaucagguagggcaaacug

SEQ ID NO: 6908 - RNA, 27 nt, Artificial Sequence
  Synthetic oligonucleotide
gaagacaucuuugaacaccuuugccuu

SEQ ID NO: 6909 - RNA, 27 nt, Artificial Sequence
  Synthetic oligonucleotide
ggaagacaucuuugaacaccuuugccu

SEQ ID NO: 6910 - RNA, 27 nt, Artificial Sequence
  Synthetic oligonucleotide
aggaagacaucuuugaacaccuuugcc

SEQ ID NO: 6911 - RNA, 27 nt, Artificial Sequence
  Synthetic oligonucleotide
caggaagacaucuuugaacaccuuugc

SEQ ID NO: 6912 - RNA, 27 nt, Artificial Sequence
  Synthetic oligonucleotide
ccaggaagacaucuuugaacaccuuug

SEQ ID NO: 6913 - RNA, 27 nt, Artificial Sequence
  Synthetic oligonucleotide
uccaggaagacaucuuugaacaccuuu

SEQ ID NO: 6914 - RNA, 27 nt, Artificial Sequence
  Synthetic oligonucleotide
uuccaggaagacaucuuugaacaccuu

SEQ ID NO: 6915 - RNA, 27 nt, Artificial Sequence
  Synthetic oligonucleotide
uuuccaggaagacaucuuugaacaccu

SEQ ID NO: 6916 - RNA, 27 nt, Artificial Sequence
  Synthetic oligonucleotide
auuuccaggaagacaucuuugaacacc

SEQ ID NO: 6917 - RNA, 27 nt, Artificial Sequence
  Synthetic oligonucleotide
cauuuccaggaagacaucuuugaacac

SEQ ID NO: 6918 - RNA, 27 nt, Artificial Sequence
  Synthetic oligonucleotide
ucauuuccaggaagacaucuuugaaca

SEQ ID NO: 6919 - RNA, 27 nt, Artificial Sequence
  Synthetic oligonucleotide
uucauuuccaggaagacaucuuugaac

SEQ ID NO: 6920 - RNA, 27 nt, Artificial Sequence
  Synthetic oligonucleotide
auucauuuccaggaagacaucuuugaa

SEQ ID NO: 6921 - RNA, 27 nt, Artificial Sequence
  Synthetic oligonucleotide
uauucauuuccaggaagacaucuuuga

SEQ ID NO: 6922 - RNA, 27 nt, Artificial Sequence
  Synthetic oligonucleotide
auauucauuuccaggaagacaucuuug

SEQ ID NO: 6923 - RNA, 27 nt, Artificial Sequence
  Synthetic oligonucleotide
uauauucauuuccaggaagacaucuuu

SEQ ID NO: 6924 - RNA, 27 nt, Artificial Sequence
  Synthetic oligonucleotide
gguauauucauuuccaggaagacaucu

SEQ ID NO: 6925 - RNA, 27 nt, Artificial Sequence
  Synthetic oligonucleotide
ugguauauucauuuccaggaagacauc

SEQ ID NO: 6926 - RNA, 27 nt, Artificial Sequence
  Synthetic oligonucleotide
augguauauucauuuccaggaagacau

SEQ ID NO: 6927 - RNA, 27 nt, Artificial Sequence
  Synthetic oligonucleotide
uaugguauauucauuuccaggaagaca

SEQ ID NO: 6928 - RNA, 27 nt, Artificial Sequence
  Synthetic oligonucleotide
auaugguauauucauuuccaggaagac

SEQ ID NO: 6929 - RNA, 27 nt, Artificial Sequence
  Synthetic oligonucleotide
aauaugguauauucauuuccaggaaga

SEQ ID NO: 6930 - RNA, 27 nt, Artificial Sequence
  Synthetic oligonucleotide
gaauaugguauauucauuuccaggaag

SEQ ID NO: 6931 - RNA, 27 nt, Artificial Sequence
  Synthetic oligonucleotide
agaauaugguauauucauuuccaggaa

SEQ ID NO: 6932 - RNA, 27 nt, Artificial Sequence
  Synthetic oligonucleotide
uccucguacaacagaauaugguauauu

SEQ ID NO: 6933 - RNA, 27 nt, Artificial Sequence
  Synthetic oligonucleotide
cuccucguacaacagaauaugguauau

SEQ ID NO: 6934 - RNA, 27 nt, Artificial Sequence
  Synthetic oligonucleotide
ucuccucguacaacagaauaugguaua

SEQ ID NO: 6935 - RNA, 27 nt, Artificial Sequence
  Synthetic oligonucleotide
uucuccucguacaacagaauaugguau

SEQ ID NO: 6936 - RNA, 27 nt, Artificial Sequence
  Synthetic oligonucleotide
guucuccucguacaacagaauauggua

SEQ ID NO: 6937 - RNA, 27 nt, Artificial Sequence
  Synthetic oligonucleotide
uguucuccucguacaacagaauauggu

SEQ ID NO: 6938 - RNA, 27 nt, Artificial Sequence
  Synthetic oligonucleotide
cuguucuccucguacaacagaauaugg

SEQ ID NO: 6939 - RNA, 27 nt, Artificial Sequence
  Synthetic oligonucleotide
ucuguucuccucguacaacagaauaug

SEQ ID NO: 6940 - RNA, 27 nt, Artificial Sequence
  Synthetic oligonucleotide
aucuguucuccucguacaacagaauau

SEQ ID NO: 6941 - RNA, 27 nt, Artificial Sequence
  Synthetic oligonucleotide
gaucuguucuccucguacaacagaaua

SEQ ID NO: 6942 - RNA, 27 nt, Artificial Sequence
  Synthetic oligonucleotide
ggaucuguucuccucguacaacagaau

SEQ ID NO: 6943 - RNA, 27 nt, Artificial Sequence
  Synthetic oligonucleotide
uggaucuguucuccucguacaacagaa

SEQ ID NO: 6944 - RNA, 27 nt, Artificial Sequence
  Synthetic oligonucleotide
uuggaucuguucuccucguacaacaga

SEQ ID NO: 6945 - RNA, 27 nt, Artificial Sequence
  Synthetic oligonucleotide
gaaguccuauaguuguaaacaguuccu

SEQ ID NO: 6946 - RNA, 27 nt, Artificial Sequence
  Synthetic oligonucleotide
agaaguccuauaguuguaaacaguucc

SEQ ID NO: 6947 - RNA, 27 nt, Artificial Sequence
  Synthetic oligonucleotide
cagaaguccuauaguuguaaacaguuc

SEQ ID NO: 6948 - RNA, 27 nt, Artificial Sequence
  Synthetic oligonucleotide
ccagaaguccuauaguuguaaacaguu

SEQ ID NO: 6949 - RNA, 27 nt, Artificial Sequence
  Synthetic oligonucleotide
cccagaaguccuauaguuguaaacagu

SEQ ID NO: 6950 - RNA, 27 nt, Artificial Sequence
  Synthetic oligonucleotide
ucccagaaguccuauaguuguaaacag

SEQ ID NO: 6951 - RNA, 27 nt, Artificial Sequence
  Synthetic oligonucleotide
aucccagaaguccuauaguuguaaaca

SEQ ID NO: 6952 - RNA, 27 nt, Artificial Sequence
  Synthetic oligonucleotide
caucccagaaguccuauaguuguaaac

SEQ ID NO: 6953 - RNA, 27 nt, Artificial Sequence
  Synthetic oligonucleotide
gcaucccagaaguccuauaguuguaaa

SEQ ID NO: 6954 - RNA, 27 nt, Artificial Sequence
  Synthetic oligonucleotide
ugcaucccagaaguccuauaguuguaa

SEQ ID NO: 6955 - RNA, 27 nt, Artificial Sequence
  Synthetic oligonucleotide
cugcaucccagaaguccuauaguugua

SEQ ID NO: 6956 - RNA, 27 nt, Artificial Sequence
  Synthetic oligonucleotide
acugcaucccagaaguccuauaguugu

SEQ ID NO: 6957 - RNA, 27 nt, Artificial Sequence
  Synthetic oligonucleotide
aacugcaucccagaaguccuauaguug

SEQ ID NO: 6958 - RNA, 27 nt, Artificial Sequence
  Synthetic oligonucleotide
gaacugcaucccagaaguccuauaguu

SEQ ID NO: 6959 - RNA, 27 nt, Artificial Sequence
  Synthetic oligonucleotide
agaacugcaucccagaaguccuauagu

SEQ ID NO: 6960 - RNA, 27 nt, Artificial Sequence
  Synthetic oligonucleotide
cagaacugcaucccagaaguccuauag

SEQ ID NO: 6961 - RNA, 27 nt, Artificial Sequence
  Synthetic oligonucleotide
acagaacugcaucccagaaguccuaua

SEQ ID NO: 6962 - RNA, 27 nt, Artificial Sequence
  Synthetic oligonucleotide
cacagaacugcaucccagaaguccuau

SEQ ID NO: 6963 - RNA, 27 nt, Artificial Sequence
  Synthetic oligonucleotide
gcagauucccuccacagcagacauuuu

SEQ ID NO: 6964 - RNA, 27 nt, Artificial Sequence
  Synthetic oligonucleotide
ugcagauucccuccacagcagacauuu

SEQ ID NO: 6965 - RNA, 27 nt, Artificial Sequence
  Synthetic oligonucleotide
gugcagauucccuccacagcagacauu

SEQ ID NO: 6966 - RNA, 27 nt, Artificial Sequence
  Synthetic oligonucleotide
agugcagauucccuccacagcagacau

SEQ ID NO: 6967 - RNA, 27 nt, Artificial Sequence
  Synthetic oligonucleotide
aagugcagauucccuccacagcagaca

SEQ ID NO: 6968 - RNA, 27 nt, Artificial Sequence
  Synthetic oligonucleotide
gaagugcagauucccuccacagcagac

SEQ ID NO: 6969 - RNA, 27 nt, Artificial Sequence
  Synthetic oligonucleotide
cgaagugcagauucccuccacagcaga

SEQ ID NO: 6970 - RNA, 27 nt, Artificial Sequence
  Synthetic oligonucleotide
ccgaagugcagauucccuccacagcag

SEQ ID NO: 6971 - RNA, 27 nt, Artificial Sequence
  Synthetic oligonucleotide
uccgaagugcagauucccuccacagca

SEQ ID NO: 6972 - RNA, 27 nt, Artificial Sequence
  Synthetic oligonucleotide
uuccgaagugcagauucccuccacagc

SEQ ID NO: 6973 - RNA, 27 nt, Artificial Sequence
  Synthetic oligonucleotide
uuuccgaagugcagauucccuccacag

SEQ ID NO: 6974 - RNA, 27 nt, Artificial Sequence
  Synthetic oligonucleotide
cuuuccgaagugcagauucccuccaca

SEQ ID NO: 6975 - RNA, 27 nt, Artificial Sequence
  Synthetic oligonucleotide
ccugaugaucaaugacugggcuuuccg

SEQ ID NO: 6976 - RNA, 27 nt, Artificial Sequence
  Synthetic oligonucleotide
cccugaugaucaaugacugggcuuucc

SEQ ID NO: 6977 - RNA, 27 nt, Artificial Sequence
  Synthetic oligonucleotide
gcccugaugaucaaugacugggcuuuc

SEQ ID NO: 6978 - RNA, 27 nt, Artificial Sequence
  Synthetic oligonucleotide
ugcccugaugaucaaugacugggcuuu

SEQ ID NO: 6979 - RNA, 27 nt, Artificial Sequence
  Synthetic oligonucleotide
gugcccugaugaucaaugacugggcuu

SEQ ID NO: 6980 - RNA, 27 nt, Artificial Sequence
  Synthetic oligonucleotide
ugugcccugaugaucaaugacugggcu

SEQ ID NO: 6981 - RNA, 27 nt, Artificial Sequence
  Synthetic oligonucleotide
uugugcccugaugaucaaugacugggc

SEQ ID NO: 6982 - RNA, 27 nt, Artificial Sequence
  Synthetic oligonucleotide
uuugugcccugaugaucaaugacuggg

SEQ ID NO: 6983 - RNA, 27 nt, Artificial Sequence
  Synthetic oligonucleotide
cuuugugcccugaugaucaaugacugg

SEQ ID NO: 6984 - RNA, 27 nt, Artificial Sequence
  Synthetic oligonucleotide
acuuugugcccugaugaucaaugacug

SEQ ID NO: 6985 - RNA, 27 nt, Artificial Sequence
  Synthetic oligonucleotide
gacuuugugcccugaugaucaaugacu

SEQ ID NO: 6986 - RNA, 27 nt, Artificial Sequence
  Synthetic oligonucleotide
ggacuuugugcccugaugaucaaugac

SEQ ID NO: 6987 - RNA, 27 nt, Artificial Sequence
  Synthetic oligonucleotide
aggacuuugugcccugaugaucaauga

SEQ ID NO: 6988 - RNA, 27 nt, Artificial Sequence
  Synthetic oligonucleotide
gaggacuuugugcccugaugaucaaug

SEQ ID NO: 6989 - RNA, 27 nt, Artificial Sequence
  Synthetic oligonucleotide
ggaggacuuugugcccugaugaucaau

SEQ ID NO: 6990 - RNA, 27 nt, Artificial Sequence
  Synthetic oligonucleotide
uggaggacuuugugcccugaugaucaa

SEQ ID NO: 6991 - RNA, 27 nt, Artificial Sequence
  Synthetic oligonucleotide
uuggaggacuuugugcccugaugauca

SEQ ID NO: 6992 - RNA, 27 nt, Artificial Sequence
  Synthetic oligonucleotide
uuuggaggacuuugugcccugaugauc

SEQ ID NO: 6993 - RNA, 27 nt, Artificial Sequence
  Synthetic oligonucleotide
auuuggaggacuuugugcccugaugau

SEQ ID NO: 6994 - RNA, 27 nt, Artificial Sequence
  Synthetic oligonucleotide
cauuuggaggacuuugugcccugauga

SEQ ID NO: 6995 - RNA, 27 nt, Artificial Sequence
  Synthetic oligonucleotide
acauuuggaggacuuugugcccugaug

SEQ ID NO: 6996 - RNA, 27 nt, Artificial Sequence
  Synthetic oligonucleotide
cacauuuggaggacuuugugcccugau

SEQ ID NO: 6997 - RNA, 27 nt, Artificial Sequence
  Synthetic oligonucleotide
ugacuggaggagcccucuacuuucugg

SEQ ID NO: 6998 - RNA, 27 nt, Artificial Sequence
  Synthetic oligonucleotide
ggccaauuuccagaggaagcacaguga

SEQ ID NO: 6999 - RNA, 27 nt, Artificial Sequence
  Synthetic oligonucleotide
aggccaauuuccagaggaagcacagug

SEQ ID NO: 7000 - RNA, 27 nt, Artificial Sequence
  Synthetic oligonucleotide
aaggccaauuuccagaggaagcacagu

SEQ ID NO: 7001 - RNA, 27 nt, Artificial Sequence
  Synthetic oligonucleotide
gaaggccaauuuccagaggaagcacag

SEQ ID NO: 7002 - RNA, 27 nt, Artificial Sequence
  Synthetic oligonucleotide
uuuuacuaagauuucuuuuccaaacca

SEQ ID NO: 7003 - RNA, 27 nt, Artificial Sequence
  Synthetic oligonucleotide
uuuuuacuaagauuucuuuuccaaacc

SEQ ID NO: 7004 - RNA, 27 nt, Artificial Sequence
  Synthetic oligonucleotide
guuuuuacuaagauuucuuuuccaaac

SEQ ID NO: 7005 - RNA, 27 nt, Artificial Sequence
  Synthetic oligonucleotide
uguuuuuacuaagauuucuuuuccaaa

SEQ ID NO: 7006 - RNA, 27 nt, Artificial Sequence
  Synthetic oligonucleotide
auguuuuuacuaagauuucuuuuccaa

SEQ ID NO: 7007 - RNA, 27 nt, Artificial Sequence
  Synthetic oligonucleotide
aauguuuuuacuaagauuucuuuucca

SEQ ID NO: 7008 - RNA, 27 nt, Artificial Sequence
  Synthetic oligonucleotide
uaauguuuuuacuaagauuucuuuucc

SEQ ID NO: 7009 - RNA, 27 nt, Artificial Sequence
  Synthetic oligonucleotide
ugacaccuucuggcaccacucguaaug

SEQ ID NO: 7010 - RNA, 27 nt, Artificial Sequence
  Synthetic oligonucleotide
uugacaccuucuggcaccacucguaau

SEQ ID NO: 7011 - RNA, 27 nt, Artificial Sequence
  Synthetic oligonucleotide
uuugacaccuucuggcaccacucguaa

SEQ ID NO: 7012 - RNA, 27 nt, Artificial Sequence
  Synthetic oligonucleotide
uuuugacaccuucuggcaccacucgua

SEQ ID NO: 7013 - RNA, 27 nt, Artificial Sequence
  Synthetic oligonucleotide
cuuuugacaccuucuggcaccacucgu

SEQ ID NO: 7014 - RNA, 27 nt, Artificial Sequence
  Synthetic oligonucleotide
ccuuuugacaccuucuggcaccacucg

SEQ ID NO: 7015 - RNA, 27 nt, Artificial Sequence
  Synthetic oligonucleotide
cccuuuugacaccuucuggcaccacuc

SEQ ID NO: 7016 - RNA, 27 nt, Artificial Sequence
  Synthetic oligonucleotide
ucccuuuugacaccuucuggcaccacu

SEQ ID NO: 7017 - RNA, 27 nt, Artificial Sequence
  Synthetic oligonucleotide
uucccuuuugacaccuucuggcaccac

SEQ ID NO: 7018 - RNA, 27 nt, Artificial Sequence
  Synthetic oligonucleotide
uuucccuuuugacaccuucuggcacca

SEQ ID NO: 7019 - RNA, 27 nt, Artificial Sequence
  Synthetic oligonucleotide
cuuucccuuuugacaccuucuggcacc

SEQ ID NO: 7020 - RNA, 27 nt, Artificial Sequence
  Synthetic oligonucleotide
gcuuucccuuuugacaccuucuggcac

SEQ ID NO: 7021 - RNA, 27 nt, Artificial Sequence
  Synthetic oligonucleotide
agcuuucccuuuugacaccuucuggca

SEQ ID NO: 7022 - RNA, 27 nt, Artificial Sequence
  Synthetic oligonucleotide
uagcuuucccuuuugacaccuucuggc

SEQ ID NO: 7023 - RNA, 27 nt, Artificial Sequence
  Synthetic oligonucleotide
auagcuuucccuuuugacaccuucugg

SEQ ID NO: 7024 - RNA, 27 nt, Artificial Sequence
  Synthetic oligonucleotide
aauagcuuucccuuuugacaccuucug

SEQ ID NO: 7025 - RNA, 27 nt, Artificial Sequence
  Synthetic oligonucleotide
gaauagcuuucccuuuugacaccuucu

SEQ ID NO: 7026 - RNA, 27 nt, Artificial Sequence
  Synthetic oligonucleotide
agaauagcuuucccuuuugacaccuuc

SEQ ID NO: 7027 - RNA, 27 nt, Artificial Sequence
  Synthetic oligonucleotide
cagaauagcuuucccuuuugacaccuu

SEQ ID NO: 7028 - RNA, 27 nt, Artificial Sequence
  Synthetic oligonucleotide
ccagaauagcuuucccuuuugacaccu

SEQ ID NO: 7029 - RNA, 27 nt, Artificial Sequence
  Synthetic oligonucleotide
accagaauagcuuucccuuuugacacc

SEQ ID NO: 7030 - RNA, 27 nt, Artificial Sequence
  Synthetic oligonucleotide
caccagaauagcuuucccuuuugacac

SEQ ID NO: 7031 - RNA, 27 nt, Artificial Sequence
  Synthetic oligonucleotide
acaccagaauagcuuucccuuuugaca

SEQ ID NO: 7032 - RNA, 27 nt, Artificial Sequence
  Synthetic oligonucleotide
aacaccagaauagcuuucccuuuugac

SEQ ID NO: 7033 - RNA, 27 nt, Artificial Sequence
  Synthetic oligonucleotide
uaacaccagaauagcuuucccuuuuga

SEQ ID NO: 7034 - RNA, 27 nt, Artificial Sequence
  Synthetic oligonucleotide
guaacaccagaauagcuuucccuuuug

SEQ ID NO: 7035 - RNA, 27 nt, Artificial Sequence
  Synthetic oligonucleotide
aguaacaccagaauagcuuucccuuuu

SEQ ID NO: 7036 - RNA, 27 nt, Artificial Sequence
  Synthetic oligonucleotide
uaaauaccccuaggauccaaaguaaca

SEQ ID NO: 7037 - RNA, 27 nt, Artificial Sequence
  Synthetic oligonucleotide
auaaauaccccuaggauccaaaguaac

SEQ ID NO: 7038 - RNA, 27 nt, Artificial Sequence
  Synthetic oligonucleotide
cauaaauaccccuaggauccaaaguaa

SEQ ID NO: 7039 - RNA, 27 nt, Artificial Sequence
  Synthetic oligonucleotide
ccauaaauaccccuaggauccaaagua

SEQ ID NO: 7040 - RNA, 27 nt, Artificial Sequence
  Synthetic oligonucleotide
accauaaauaccccuaggauccaaagu

SEQ ID NO: 7041 - RNA, 27 nt, Artificial Sequence
  Synthetic oligonucleotide
uaccauaaauaccccuaggauccaaag

SEQ ID NO: 7042 - RNA, 27 nt, Artificial Sequence
  Synthetic oligonucleotide
guaccauaaauaccccuaggauccaaa

SEQ ID NO: 7043 - RNA, 27 nt, Artificial Sequence
  Synthetic oligonucleotide
gguaccauaaauaccccuaggauccaa

SEQ ID NO: 7044 - RNA, 27 nt, Artificial Sequence
  Synthetic oligonucleotide
ugguaccauaaauaccccuaggaucca

SEQ ID NO: 7045 - RNA, 27 nt, Artificial Sequence
  Synthetic oligonucleotide
guauccuguaugggaacuccuuucguc

SEQ ID NO: 7046 - RNA, 27 nt, Artificial Sequence
  Synthetic oligonucleotide
gguauccuguaugggaacuccuuucgu

SEQ ID NO: 7047 - RNA, 27 nt, Artificial Sequence
  Synthetic oligonucleotide
ggguauccuguaugggaacuccuuucg

SEQ ID NO: 7048 - RNA, 27 nt, Artificial Sequence
  Synthetic oligonucleotide
aggguauccuguaugggaacuccuuuc

SEQ ID NO: 7049 - RNA, 27 nt, Artificial Sequence
  Synthetic oligonucleotide
aaggguauccuguaugggaacuccuuu

SEQ ID NO: 7050 - RNA, 27 nt, Artificial Sequence
  Synthetic oligonucleotide
uaaggguauccuguaugggaacuccuu

SEQ ID NO: 7051 - RNA, 27 nt, Artificial Sequence
  Synthetic oligonucleotide
cuaaggguauccuguaugggaacuccu

SEQ ID NO: 7052 - RNA, 27 nt, Artificial Sequence
  Synthetic oligonucleotide
ucuaaggguauccuguaugggaacucc

SEQ ID NO: 7053 - RNA, 27 nt, Artificial Sequence
  Synthetic oligonucleotide
uuucuguuuuggggaccaaaucuaagg

SEQ ID NO: 7054 - RNA, 27 nt, Artificial Sequence
  Synthetic oligonucleotide
auuucuguuuuggggaccaaaucuaag

SEQ ID NO: 7055 - RNA, 27 nt, Artificial Sequence
  Synthetic oligonucleotide
gauuucuguuuuggggaccaaaucuaa

SEQ ID NO: 7056 - RNA, 27 nt, Artificial Sequence
  Synthetic oligonucleotide
ugauuucuguuuuggggaccaaaucua

SEQ ID NO: 7057 - RNA, 27 nt, Artificial Sequence
  Synthetic oligonucleotide
uugauuucuguuuuggggaccaaaucu

SEQ ID NO: 7058 - RNA, 27 nt, Artificial Sequence
  Synthetic oligonucleotide
uuugauuucuguuuuggggaccaaauc

SEQ ID NO: 7059 - RNA, 27 nt, Artificial Sequence
  Synthetic oligonucleotide
uuuugauuucuguuuuggggaccaaau

SEQ ID NO: 7060 - RNA, 27 nt, Artificial Sequence
  Synthetic oligonucleotide
cuuuugauuucuguuuuggggaccaaa

SEQ ID NO: 7061 - RNA, 27 nt, Artificial Sequence
  Synthetic oligonucleotide
ccuuuugauuucuguuuuggggaccaa

SEQ ID NO: 7062 - RNA, 27 nt, Artificial Sequence
  Synthetic oligonucleotide
uccuuuugauuucuguuuuggggacca

SEQ ID NO: 7063 - RNA, 27 nt, Artificial Sequence
  Synthetic oligonucleotide
auccuuuugauuucuguuuuggggacc

SEQ ID NO: 7064 - RNA, 27 nt, Artificial Sequence
  Synthetic oligonucleotide
aauccuuuugauuucuguuuuggggac

SEQ ID NO: 7065 - RNA, 27 nt, Artificial Sequence
  Synthetic oligonucleotide
aaauccuuuugauuucuguuuugggga

SEQ ID NO: 7066 - RNA, 27 nt, Artificial Sequence
  Synthetic oligonucleotide
aaaauccuuuugauuucuguuuugggg

SEQ ID NO: 7067 - RNA, 27 nt, Artificial Sequence
  Synthetic oligonucleotide
caaaauccuuuugauuucuguuuuggg

SEQ ID NO: 7068 - RNA, 27 nt, Artificial Sequence
  Synthetic oligonucleotide
ucaaaauccuuuugauuucuguuuugg

SEQ ID NO: 7069 - RNA, 27 nt, Artificial Sequence
  Synthetic oligonucleotide
cucaaaauccuuuugauuucuguuuug

SEQ ID NO: 7070 - RNA, 27 nt, Artificial Sequence
  Synthetic oligonucleotide
acucaaaauccuuuugauuucuguuuu

SEQ ID NO: 7071 - RNA, 27 nt, Artificial Sequence
  Synthetic oligonucleotide
cacucaaaauccuuuugauuucuguuu

SEQ ID NO: 7072 - RNA, 27 nt, Artificial Sequence
  Synthetic oligonucleotide
acacucaaaauccuuuugauuucuguu

SEQ ID NO: 7073 - RNA, 27 nt, Artificial Sequence
  Synthetic oligonucleotide
uuuacacucaaaauccuuuugauuucu

SEQ ID NO: 7074 - RNA, 27 nt, Artificial Sequence
  Synthetic oligonucleotide
uuuuacacucaaaauccuuuugauuuc

SEQ ID NO: 7075 - RNA, 27 nt, Artificial Sequence
  Synthetic oligonucleotide
cuuuuacacucaaaauccuuuugauuu

SEQ ID NO: 7076 - RNA, 27 nt, Artificial Sequence
  Synthetic oligonucleotide
ccuuuuacacucaaaauccuuuugauu

SEQ ID NO: 7077 - RNA, 27 nt, Artificial Sequence
  Synthetic oligonucleotide
guccuuuuacacucaaaauccuuuuga

SEQ ID NO: 7078 - RNA, 27 nt, Artificial Sequence
  Synthetic oligonucleotide
aguccuuuuacacucaaaauccuuuug

SEQ ID NO: 7079 - RNA, 27 nt, Artificial Sequence
  Synthetic oligonucleotide
caguccuuuuacacucaaaauccuuuu

SEQ ID NO: 7080 - RNA, 27 nt, Artificial Sequence
  Synthetic oligonucleotide
gcaguccuuuuacacucaaaauccuuu

SEQ ID NO: 7081 - RNA, 27 nt, Artificial Sequence
  Synthetic oligonucleotide
agcaguccuuuuacacucaaaauccuu

SEQ ID NO: 7082 - RNA, 27 nt, Artificial Sequence
  Synthetic oligonucleotide
aagcaguccuuuuacacucaaaauccu

SEQ ID NO: 7083 - RNA, 27 nt, Artificial Sequence
  Synthetic oligonucleotide
caagcaguccuuuuacacucaaaaucc

SEQ ID NO: 7084 - RNA, 27 nt, Artificial Sequence
  Synthetic oligonucleotide
acaagcaguccuuuuacacucaaaauc

SEQ ID NO: 7085 - RNA, 27 nt, Artificial Sequence
  Synthetic oligonucleotide
uacaagcaguccuuuuacacucaaaau

SEQ ID NO: 7086 - RNA, 27 nt, Artificial Sequence
  Synthetic oligonucleotide
cuacaagcaguccuuuuacacucaaaa

SEQ ID NO: 7087 - RNA, 27 nt, Artificial Sequence
  Synthetic oligonucleotide
ccuacaagcaguccuuuuacacucaaa

SEQ ID NO: 7088 - RNA, 27 nt, Artificial Sequence
  Synthetic oligonucleotide
accuacaagcaguccuuuuacacucaa

SEQ ID NO: 7089 - RNA, 27 nt, Artificial Sequence
  Synthetic oligonucleotide
caccuacaagcaguccuuuuacacuca

SEQ ID NO: 7090 - RNA, 27 nt, Artificial Sequence
  Synthetic oligonucleotide
ucaccuacaagcaguccuuuuacacuc

SEQ ID NO: 7091 - RNA, 27 nt, Artificial Sequence
  Synthetic oligonucleotide
cucaccuacaagcaguccuuuuacacu

SEQ ID NO: 7092 - RNA, 27 nt, Artificial Sequence
  Synthetic oligonucleotide
ucucaccuacaagcaguccuuuuacac

SEQ ID NO: 7093 - RNA, 27 nt, Artificial Sequence
  Synthetic oligonucleotide
aucucaccuacaagcaguccuuuuaca

SEQ ID NO: 7094 - RNA, 27 nt, Artificial Sequence
  Synthetic oligonucleotide
gaucucaccuacaagcaguccuuuuac

SEQ ID NO: 7095 - RNA, 27 nt, Artificial Sequence
  Synthetic oligonucleotide
agaucucaccuacaagcaguccuuuua

SEQ ID NO: 7096 - RNA, 27 nt, Artificial Sequence
  Synthetic oligonucleotide
aagaucucaccuacaagcaguccuuuu

SEQ ID NO: 7097 - RNA, 27 nt, Artificial Sequence
  Synthetic oligonucleotide
caagaucucaccuacaagcaguccuuu

SEQ ID NO: 7098 - RNA, 27 nt, Artificial Sequence
  Synthetic oligonucleotide
acaagaucucaccuacaagcaguccuu

SEQ ID NO: 7099 - RNA, 27 nt, Artificial Sequence
  Synthetic oligonucleotide
gacaagaucucaccuacaagcaguccu

SEQ ID NO: 7100 - RNA, 27 nt, Artificial Sequence
  Synthetic oligonucleotide
agacaagaucucaccuacaagcagucc

SEQ ID NO: 7101 - RNA, 27 nt, Artificial Sequence
  Synthetic oligonucleotide
cagacaagaucucaccuacaagcaguc

SEQ ID NO: 7102 - RNA, 27 nt, Artificial Sequence
  Synthetic oligonucleotide
gcagacaagaucucaccuacaagcagu

SEQ ID NO: 7103 - RNA, 27 nt, Artificial Sequence
  Synthetic oligonucleotide
ugcagacaagaucucaccuacaagcag

SEQ ID NO: 7104 - RNA, 27 nt, Artificial Sequence
  Synthetic oligonucleotide
cugcagacaagaucucaccuacaagca

SEQ ID NO: 7105 - RNA, 27 nt, Artificial Sequence
  Synthetic oligonucleotide
acugcagacaagaucucaccuacaagc

SEQ ID NO: 7106 - RNA, 27 nt, Artificial Sequence
  Synthetic oligonucleotide
aacugcagacaagaucucaccuacaag

SEQ ID NO: 7107 - RNA, 27 nt, Artificial Sequence
  Synthetic oligonucleotide
gaacugcagacaagaucucaccuacaa

SEQ ID NO: 7108 - RNA, 27 nt, Artificial Sequence
  Synthetic oligonucleotide
agaacugcagacaagaucucaccuaca

SEQ ID NO: 7109 - RNA, 27 nt, Artificial Sequence
  Synthetic oligonucleotide
uagaacugcagacaagaucucaccuac

SEQ ID NO: 7110 - RNA, 27 nt, Artificial Sequence
  Synthetic oligonucleotide
uuagaacugcagacaagaucucaccua

SEQ ID NO: 7111 - RNA, 27 nt, Artificial Sequence
  Synthetic oligonucleotide
cuuagaacugcagacaagaucucaccu

SEQ ID NO: 7112 - RNA, 27 nt, Artificial Sequence
  Synthetic oligonucleotide
acuuagaacugcagacaagaucucacc

SEQ ID NO: 7113 - RNA, 27 nt, Artificial Sequence
  Synthetic oligonucleotide
gacuuagaacugcagacaagaucucac

SEQ ID NO: 7114 - RNA, 27 nt, Artificial Sequence
  Synthetic oligonucleotide
ugacuuagaacugcagacaagaucuca

SEQ ID NO: 7115 - RNA, 27 nt, Artificial Sequence
  Synthetic oligonucleotide
cugacuuagaacugcagacaagaucuc

SEQ ID NO: 7116 - RNA, 27 nt, Artificial Sequence
  Synthetic oligonucleotide
ccugacuuagaacugcagacaagaucu

SEQ ID NO: 7117 - RNA, 27 nt, Artificial Sequence
  Synthetic oligonucleotide
uccugacuuagaacugcagacaagauc

SEQ ID NO: 7118 - RNA, 27 nt, Artificial Sequence
  Synthetic oligonucleotide
uuccugacuuagaacugcagacaagau

SEQ ID NO: 7119 - RNA, 27 nt, Artificial Sequence
  Synthetic oligonucleotide
cuuccugacuuagaacugcagacaaga

SEQ ID NO: 7120 - RNA, 27 nt, Artificial Sequence
  Synthetic oligonucleotide
guggguuaggauauugaugccuuccug

SEQ ID NO: 7121 - RNA, 27 nt, Artificial Sequence
  Synthetic oligonucleotide
gguggguuaggauauugaugccuuccu

SEQ ID NO: 7122 - RNA, 27 nt, Artificial Sequence
  Synthetic oligonucleotide
agguggguuaggauauugaugccuucc

SEQ ID NO: 7123 - RNA, 27 nt, Artificial Sequence
  Synthetic oligonucleotide
gagguggguuaggauauugaugccuuc

SEQ ID NO: 7124 - RNA, 27 nt, Artificial Sequence
  Synthetic oligonucleotide
ggagguggguuaggauauugaugccuu

SEQ ID NO: 7125 - RNA, 27 nt, Artificial Sequence
  Synthetic oligonucleotide
gggagguggguuaggauauugaugccu

SEQ ID NO: 7126 - RNA, 27 nt, Artificial Sequence
  Synthetic oligonucleotide
ggggagguggguuaggauauugaugcc

SEQ ID NO: 7127 - RNA, 27 nt, Artificial Sequence
  Synthetic oligonucleotide
uggggagguggguuaggauauugaugc

SEQ ID NO: 7128 - RNA, 27 nt, Artificial Sequence
  Synthetic oligonucleotide
uuggggagguggguuaggauauugaug

SEQ ID NO: 7129 - RNA, 27 nt, Artificial Sequence
  Synthetic oligonucleotide
uuuggggagguggguuaggauauugau

SEQ ID NO: 7130 - RNA, 27 nt, Artificial Sequence
  Synthetic oligonucleotide
cuuuggggagguggguuaggauauuga

SEQ ID NO: 7131 - RNA, 27 nt, Artificial Sequence
  Synthetic oligonucleotide
ccuuuggggagguggguuaggauauug

SEQ ID NO: 7132 - RNA, 27 nt, Artificial Sequence
  Synthetic oligonucleotide
cccuuuggggagguggguuaggauauu

SEQ ID NO: 7133 - RNA, 27 nt, Artificial Sequence
  Synthetic oligonucleotide
ugcacucccuuuggggagguggguuag

SEQ ID NO: 7134 - RNA, 27 nt, Artificial Sequence
  Synthetic oligonucleotide
cugcacucccuuuggggagguggguua

SEQ ID NO: 7135 - RNA, 27 nt, Artificial Sequence
  Synthetic oligonucleotide
ucugcacucccuuuggggagguggguu

SEQ ID NO: 7136 - RNA, 27 nt, Artificial Sequence
  Synthetic oligonucleotide
ggacaacgcucaucagcuccgccucug

SEQ ID NO: 7137 - RNA, 27 nt, Artificial Sequence
  Synthetic oligonucleotide
cugggacaacgcucaucagcuccgccu

SEQ ID NO: 7138 - RNA, 27 nt, Artificial Sequence
  Synthetic oligonucleotide
acugggacaacgcucaucagcuccgcc

SEQ ID NO: 7139 - RNA, 27 nt, Artificial Sequence
  Synthetic oligonucleotide
uacugggacaacgcucaucagcuccgc

SEQ ID NO: 7140 - RNA, 27 nt, Artificial Sequence
  Synthetic oligonucleotide
auacugggacaacgcucaucagcuccg

SEQ ID NO: 7141 - RNA, 27 nt, Artificial Sequence
  Synthetic oligonucleotide
aauacugggacaacgcucaucagcucc

SEQ ID NO: 7142 - RNA, 27 nt, Artificial Sequence
  Synthetic oligonucleotide
gaauacugggacaacgcucaucagcuc

SEQ ID NO: 7143 - RNA, 27 nt, Artificial Sequence
  Synthetic oligonucleotide
agaauacugggacaacgcucaucagcu

SEQ ID NO: 7144 - RNA, 27 nt, Artificial Sequence
  Synthetic oligonucleotide
uagaauacugggacaacgcucaucagc

SEQ ID NO: 7145 - RNA, 27 nt, Artificial Sequence
  Synthetic oligonucleotide
auagaauacugggacaacgcucaucag

SEQ ID NO: 7146 - RNA, 27 nt, Artificial Sequence
  Synthetic oligonucleotide
cauagaauacugggacaacgcucauca

SEQ ID NO: 7147 - RNA, 27 nt, Artificial Sequence
  Synthetic oligonucleotide
acauagaauacugggacaacgcucauc

SEQ ID NO: 7148 - RNA, 27 nt, Artificial Sequence
  Synthetic oligonucleotide
aacauagaauacugggacaacgcucau

SEQ ID NO: 7149 - RNA, 27 nt, Artificial Sequence
  Synthetic oligonucleotide
aaacauagaauacugggacaacgcuca

SEQ ID NO: 7150 - RNA, 27 nt, Artificial Sequence
  Synthetic oligonucleotide
aaaacauagaauacugggacaacgcuc

SEQ ID NO: 7151 - RNA, 27 nt, Artificial Sequence
  Synthetic oligonucleotide
aaaaacauagaauacugggacaacgcu

SEQ ID NO: 7152 - RNA, 27 nt, Artificial Sequence
  Synthetic oligonucleotide
gaaaaacauagaauacugggacaacgc

SEQ ID NO: 7153 - RNA, 27 nt, Artificial Sequence
  Synthetic oligonucleotide
ugaaaaacauagaauacugggacaacg

SEQ ID NO: 7154 - RNA, 27 nt, Artificial Sequence
  Synthetic oligonucleotide
gugaaaaacauagaauacugggacaac

SEQ ID NO: 7155 - RNA, 27 nt, Artificial Sequence
  Synthetic oligonucleotide
agugaaaaacauagaauacugggacaa

SEQ ID NO: 7156 - RNA, 27 nt, Artificial Sequence
  Synthetic oligonucleotide
uagugaaaaacauagaauacugggaca

SEQ ID NO: 7157 - RNA, 27 nt, Artificial Sequence
  Synthetic oligonucleotide
guagugaaaaacauagaauacugggac

SEQ ID NO: 7158 - RNA, 27 nt, Artificial Sequence
  Synthetic oligonucleotide
agguagugaaaaacauagaauacuggg

SEQ ID NO: 7159 - RNA, 27 nt, Artificial Sequence
  Synthetic oligonucleotide
cagguagugaaaaacauagaauacugg

SEQ ID NO: 7160 - RNA, 27 nt, Artificial Sequence
  Synthetic oligonucleotide
ccagguagugaaaaacauagaauacug

SEQ ID NO: 7161 - RNA, 27 nt, Artificial Sequence
  Synthetic oligonucleotide
uccagguagugaaaaacauagaauacu

SEQ ID NO: 7162 - RNA, 27 nt, Artificial Sequence
  Synthetic oligonucleotide
uuccagguagugaaaaacauagaauac

SEQ ID NO: 7163 - RNA, 27 nt, Artificial Sequence
  Synthetic oligonucleotide
uuuccagguagugaaaaacauagaaua

SEQ ID NO: 7164 - RNA, 27 nt, Artificial Sequence
  Synthetic oligonucleotide
guuuccagguagugaaaaacauagaau

SEQ ID NO: 7165 - RNA, 27 nt, Artificial Sequence
  Synthetic oligonucleotide
uguuuccagguagugaaaaacauagaa

SEQ ID NO: 7166 - RNA, 27 nt, Artificial Sequence
  Synthetic oligonucleotide
cuguuuccagguagugaaaaacauaga

SEQ ID NO: 7167 - RNA, 27 nt, Artificial Sequence
  Synthetic oligonucleotide
ccuguuuccagguagugaaaaacauag

SEQ ID NO: 7168 - RNA, 27 nt, Artificial Sequence
  Synthetic oligonucleotide
uccuguuuccagguagugaaaaacaua

SEQ ID NO: 7169 - RNA, 27 nt, Artificial Sequence
  Synthetic oligonucleotide
uuccuguuuccagguagugaaaaacau

SEQ ID NO: 7170 - RNA, 27 nt, Artificial Sequence
  Synthetic oligonucleotide
uuuccuguuuccagguagugaaaaaca

SEQ ID NO: 7171 - RNA, 27 nt, Artificial Sequence
  Synthetic oligonucleotide
auuuccuguuuccagguagugaaaaac

SEQ ID NO: 7172 - RNA, 27 nt, Artificial Sequence
  Synthetic oligonucleotide
gauuuccuguuuccagguagugaaaaa

SEQ ID NO: 7173 - RNA, 27 nt, Artificial Sequence
  Synthetic oligonucleotide
ugauuuccuguuuccagguagugaaaa

SEQ ID NO: 7174 - RNA, 27 nt, Artificial Sequence
  Synthetic oligonucleotide
augauuuccuguuuccagguagugaaa

SEQ ID NO: 7175 - RNA, 27 nt, Artificial Sequence
  Synthetic oligonucleotide
aaugauuuccuguuuccagguagugaa

SEQ ID NO: 7176 - RNA, 27 nt, Artificial Sequence
  Synthetic oligonucleotide
caaugauuuccuguuuccagguaguga

SEQ ID NO: 7177 - RNA, 27 nt, Artificial Sequence
  Synthetic oligonucleotide
ccaaugauuuccuguuuccagguagug

SEQ ID NO: 7178 - RNA, 27 nt, Artificial Sequence
  Synthetic oligonucleotide
uccaaugauuuccuguuuccagguagu

SEQ ID NO: 7179 - RNA, 27 nt, Artificial Sequence
  Synthetic oligonucleotide
uuccaaugauuuccuguuuccagguag

SEQ ID NO: 7180 - RNA, 27 nt, Artificial Sequence
  Synthetic oligonucleotide
guuccaaugauuuccuguuuccaggua

SEQ ID NO: 7181 - RNA, 27 nt, Artificial Sequence
  Synthetic oligonucleotide
uguuccaaugauuuccuguuuccaggu

SEQ ID NO: 7182 - RNA, 27 nt, Artificial Sequence
  Synthetic oligonucleotide
auguuccaaugauuuccuguuuccagg

SEQ ID NO: 7183 - RNA, 27 nt, Artificial Sequence
  Synthetic oligonucleotide
aauguuccaaugauuuccuguuuccag

SEQ ID NO: 7184 - RNA, 27 nt, Artificial Sequence
  Synthetic oligonucleotide
aaauguuccaaugauuuccuguuucca

SEQ ID NO: 7185 - RNA, 27 nt, Artificial Sequence
  Synthetic oligonucleotide
aaaauguuccaaugauuuccuguuucc

SEQ ID NO: 7186 - RNA, 27 nt, Artificial Sequence
  Synthetic oligonucleotide
aaaaauguuccaaugauuuccuguuuc

SEQ ID NO: 7187 - RNA, 27 nt, Artificial Sequence
  Synthetic oligonucleotide
gaaaaauguuccaaugauuuccuguuu

SEQ ID NO: 7188 - RNA, 27 nt, Artificial Sequence
  Synthetic oligonucleotide
ugaaaaauguuccaaugauuuccuguu

SEQ ID NO: 7189 - RNA, 27 nt, Artificial Sequence
  Synthetic oligonucleotide
gaaugaaaaauguuccaaugauuuccu

SEQ ID NO: 7190 - RNA, 27 nt, Artificial Sequence
  Synthetic oligonucleotide
agaaugaaaaauguuccaaugauuucc

SEQ ID NO: 7191 - RNA, 27 nt, Artificial Sequence
  Synthetic oligonucleotide
cagaaugaaaaauguuccaaugauuuc

SEQ ID NO: 7192 - RNA, 27 nt, Artificial Sequence
  Synthetic oligonucleotide
ucagaaugaaaaauguuccaaugauuu

SEQ ID NO: 7193 - RNA, 27 nt, Artificial Sequence
  Synthetic oligonucleotide
gucagaaugaaaaauguuccaaugauu

SEQ ID NO: 7194 - RNA, 27 nt, Artificial Sequence
  Synthetic oligonucleotide
ggucagaaugaaaaauguuccaaugau

SEQ ID NO: 7195 - RNA, 27 nt, Artificial Sequence
  Synthetic oligonucleotide
gggucagaaugaaaaauguuccaauga

SEQ ID NO: 7196 - RNA, 27 nt, Artificial Sequence
  Synthetic oligonucleotide
guuucugcuuuucaauuaaugggucag

SEQ ID NO: 7197 - RNA, 27 nt, Artificial Sequence
  Synthetic oligonucleotide
aacaucccuucuuuuaauuuuuucuuc

SEQ ID NO: 7198 - RNA, 27 nt, Artificial Sequence
  Synthetic oligonucleotide
caacaucccuucuuuuaauuuuuucuu

SEQ ID NO: 7199 - RNA, 27 nt, Artificial Sequence
  Synthetic oligonucleotide
ucaacaucccuucuuuuaauuuuuucu

SEQ ID NO: 7200 - RNA, 27 nt, Artificial Sequence
  Synthetic oligonucleotide
cucaacaucccuucuuuuaauuuuuuc

SEQ ID NO: 7201 - RNA, 27 nt, Artificial Sequence
  Synthetic oligonucleotide
gcucaacaucccuucuuuuaauuuuuu

SEQ ID NO: 7202 - RNA, 27 nt, Artificial Sequence
  Synthetic oligonucleotide
gcauuucuguaggacauaaugcucaac

SEQ ID NO: 7203 - RNA, 27 nt, Artificial Sequence
  Synthetic oligonucleotide
cagcauuucuguaggacauaaugcuca

SEQ ID NO: 7204 - RNA, 27 nt, Artificial Sequence
  Synthetic oligonucleotide
ucagcauuucuguaggacauaaugcuc

SEQ ID NO: 7205 - RNA, 27 nt, Artificial Sequence
  Synthetic oligonucleotide
gucagcauuucuguaggacauaaugcu

SEQ ID NO: 7206 - RNA, 27 nt, Artificial Sequence
  Synthetic oligonucleotide
agucagcauuucuguaggacauaaugc

SEQ ID NO: 7207 - RNA, 27 nt, Artificial Sequence
  Synthetic oligonucleotide
uagucagcauuucuguaggacauaaug

SEQ ID NO: 7208 - RNA, 27 nt, Artificial Sequence
  Synthetic oligonucleotide
guagucagcauuucuguaggacauaau

SEQ ID NO: 7209 - RNA, 27 nt, Artificial Sequence
  Synthetic oligonucleotide
aguagucagcauuucuguaggacauaa

SEQ ID NO: 7210 - RNA, 27 nt, Artificial Sequence
  Synthetic oligonucleotide
gaguagucagcauuucuguaggacaua

SEQ ID NO: 7211 - RNA, 27 nt, Artificial Sequence
  Synthetic oligonucleotide
agaguagucagcauuucuguaggacau

SEQ ID NO: 7212 - RNA, 27 nt, Artificial Sequence
  Synthetic oligonucleotide
aagaguagucagcauuucuguaggaca

SEQ ID NO: 7213 - RNA, 27 nt, Artificial Sequence
  Synthetic oligonucleotide
uaagaguagucagcauuucuguaggac

SEQ ID NO: 7214 - RNA, 27 nt, Artificial Sequence
  Synthetic oligonucleotide
aagcuguuaaccaagugcuagcacuuc

SEQ ID NO: 7215 - RNA, 27 nt, Artificial Sequence
  Synthetic oligonucleotide
aaagcuguuaaccaagugcuagcacuu

SEQ ID NO: 7216 - RNA, 27 nt, Artificial Sequence
  Synthetic oligonucleotide
aaaagcuguuaaccaagugcuagcacu

SEQ ID NO: 7217 - RNA, 27 nt, Artificial Sequence
  Synthetic oligonucleotide
caaaagcuguuaaccaagugcuagcac

SEQ ID NO: 7218 - RNA, 27 nt, Artificial Sequence
  Synthetic oligonucleotide
gcaaaagcuguuaaccaagugcuagca

SEQ ID NO: 7219 - RNA, 27 nt, Artificial Sequence
  Synthetic oligonucleotide
agcaaaagcuguuaaccaagugcuagc

SEQ ID NO: 7220 - RNA, 27 nt, Artificial Sequence
  Synthetic oligonucleotide
aagcaaaagcuguuaaccaagugcuag

SEQ ID NO: 7221 - RNA, 27 nt, Artificial Sequence
  Synthetic oligonucleotide
aaagcaaaagcuguuaaccaagugcua

SEQ ID NO: 7222 - RNA, 27 nt, Artificial Sequence
  Synthetic oligonucleotide
uaaagcaaaagcuguuaaccaagugcu

SEQ ID NO: 7223 - RNA, 27 nt, Artificial Sequence
  Synthetic oligonucleotide
uuaaagcaaaagcuguuaaccaagugc

SEQ ID NO: 7224 - RNA, 27 nt, Artificial Sequence
  Synthetic oligonucleotide
ucuuaaagcaaaagcuguuaaccaagu

SEQ ID NO: 7225 - RNA, 27 nt, Artificial Sequence
  Synthetic oligonucleotide
cucuuaaagcaaaagcuguuaaccaag

SEQ ID NO: 7226 - RNA, 27 nt, Artificial Sequence
  Synthetic oligonucleotide
guacucuuaaagcaaaagcuguuaacc

SEQ ID NO: 7227 - RNA, 27 nt, Artificial Sequence
  Synthetic oligonucleotide
aguacucuuaaagcaaaagcuguuaac

SEQ ID NO: 7228 - RNA, 27 nt, Artificial Sequence
  Synthetic oligonucleotide
aaguacucuuaaagcaaaagcuguuaa

SEQ ID NO: 7229 - RNA, 27 nt, Artificial Sequence
  Synthetic oligonucleotide
caaguacucuuaaagcaaaagcuguua

SEQ ID NO: 7230 - RNA, 27 nt, Artificial Sequence
  Synthetic oligonucleotide
ccaaguacucuuaaagcaaaagcuguu

SEQ ID NO: 7231 - RNA, 27 nt, Artificial Sequence
  Synthetic oligonucleotide
uccaaguacucuuaaagcaaaagcugu

SEQ ID NO: 7232 - RNA, 27 nt, Artificial Sequence
  Synthetic oligonucleotide
guccaaguacucuuaaagcaaaagcug

SEQ ID NO: 7233 - RNA, 27 nt, Artificial Sequence
  Synthetic oligonucleotide
uguccaaguacucuuaaagcaaaagcu

SEQ ID NO: 7234 - RNA, 27 nt, Artificial Sequence
  Synthetic oligonucleotide
uuguccaaguacucuuaaagcaaaagc

SEQ ID NO: 7235 - RNA, 27 nt, Artificial Sequence
  Synthetic oligonucleotide
cuuguccaaguacucuuaaagcaaaag

SEQ ID NO: 7236 - RNA, 27 nt, Artificial Sequence
  Synthetic oligonucleotide
acuuguccaaguacucuuaaagcaaaa

SEQ ID NO: 7237 - RNA, 27 nt, Artificial Sequence
  Synthetic oligonucleotide
uacuuguccaaguacucuuaaagcaaa

SEQ ID NO: 7238 - RNA, 27 nt, Artificial Sequence
  Synthetic oligonucleotide
auuuacuuguccaaguacucuuaaagc

SEQ ID NO: 7239 - RNA, 27 nt, Artificial Sequence
  Synthetic oligonucleotide
uauuuacuuguccaaguacucuuaaag

SEQ ID NO: 7240 - RNA, 27 nt, Artificial Sequence
  Synthetic oligonucleotide
aaauugaauuuugguucugcucuacgu

SEQ ID NO: 7241 - RNA, 27 nt, Artificial Sequence
  Synthetic oligonucleotide
caacuagccacaauaaagaauuacaaa

SEQ ID NO: 7242 - RNA, 27 nt, Artificial Sequence
  Synthetic oligonucleotide
ucaacuagccacaauaaagaauuacaa

SEQ ID NO: 7243 - RNA, 27 nt, Artificial Sequence
  Synthetic oligonucleotide
guugauacugugaauuuuccuugaaag

SEQ ID NO: 7244 - RNA, 27 nt, Artificial Sequence
  Synthetic oligonucleotide
gguugauacugugaauuuuccuugaaa

SEQ ID NO: 7245 - RNA, 27 nt, Artificial Sequence
  Synthetic oligonucleotide
ugguugauacugugaauuuuccuugaa

SEQ ID NO: 7246 - RNA, 27 nt, Artificial Sequence
  Synthetic oligonucleotide
uugguugauacugugaauuuuccuuga

SEQ ID NO: 7247 - RNA, 27 nt, Artificial Sequence
  Synthetic oligonucleotide
auugguugauacugugaauuuuccuug

SEQ ID NO: 7248 - RNA, 27 nt, Artificial Sequence
  Synthetic oligonucleotide
uauugguugauacugugaauuuuccuu

SEQ ID NO: 7249 - RNA, 27 nt, Artificial Sequence
  Synthetic oligonucleotide
uuauugguugauacugugaauuuuccu

SEQ ID NO: 7250 - RNA, 27 nt, Artificial Sequence
  Synthetic oligonucleotide
uuuauugguugauacugugaauuuucc

SEQ ID NO: 7251 - RNA, 27 nt, Artificial Sequence
  Synthetic oligonucleotide
uuuuauugguugauacugugaauuuuc

SEQ ID NO: 7252 - RNA, 27 nt, Artificial Sequence
  Synthetic oligonucleotide
auuuuauugguugauacugugaauuuu

SEQ ID NO: 7253 - RNA, 27 nt, Artificial Sequence
  Synthetic oligonucleotide
aauuuuauugguugauacugugaauuu

SEQ ID NO: 7254 - RNA, 27 nt, Artificial Sequence
  Synthetic oligonucleotide
uaauuuuauugguugauacugugaauu

SEQ ID NO: 7255 - RNA, 27 nt, Artificial Sequence
  Synthetic oligonucleotide
guaauuuuauugguugauacugugaau

SEQ ID NO: 7256 - RNA, 27 nt, Artificial Sequence
  Synthetic oligonucleotide
cuguaauuuuauugguugauacuguga

SEQ ID NO: 7257 - RNA, 27 nt, Artificial Sequence
  Synthetic oligonucleotide
ccuguaauuuuauugguugauacugug

SEQ ID NO: 7258 - RNA, 27 nt, Artificial Sequence
  Synthetic oligonucleotide
cccuguaauuuuauugguugauacugu

SEQ ID NO: 7259 - RNA, 27 nt, Artificial Sequence
  Synthetic oligonucleotide
acccuguaauuuuauugguugauacug

SEQ ID NO: 7260 - RNA, 27 nt, Artificial Sequence
  Synthetic oligonucleotide
uacccuguaauuuuauugguugauacu

SEQ ID NO: 7261 - RNA, 27 nt, Artificial Sequence
  Synthetic oligonucleotide
guacccuguaauuuuauugguugauac

SEQ ID NO: 7262 - RNA, 27 nt, Artificial Sequence
  Synthetic oligonucleotide
gguacccuguaauuuuauugguugaua

SEQ ID NO: 7263 - RNA, 27 nt, Artificial Sequence
  Synthetic oligonucleotide
aaguugucagcuuuaauuagagcugug

SEQ ID NO: 7264 - RNA, 27 nt, Artificial Sequence
  Synthetic oligonucleotide
aaaguugucagcuuuaauuagagcugu

SEQ ID NO: 7265 - RNA, 27 nt, Artificial Sequence
  Synthetic oligonucleotide
gaaaguugucagcuuuaauuagagcug

SEQ ID NO: 7266 - RNA, 27 nt, Artificial Sequence
  Synthetic oligonucleotide
uggcaguguauuuucaagcagaaaguu

SEQ ID NO: 7267 - RNA, 27 nt, Artificial Sequence
  Synthetic oligonucleotide
cuggcaguguauuuucaagcagaaagu

SEQ ID NO: 7268 - RNA, 27 nt, Artificial Sequence
  Synthetic oligonucleotide
gcuggcaguguauuuucaagcagaaag

SEQ ID NO: 7269 - RNA, 27 nt, Artificial Sequence
  Synthetic oligonucleotide
ggcuggcaguguauuuucaagcagaaa

SEQ ID NO: 7270 - RNA, 27 nt, Artificial Sequence
  Synthetic oligonucleotide
gggcuggcaguguauuuucaagcagaa

SEQ ID NO: 7271 - RNA, 27 nt, Artificial Sequence
  Synthetic oligonucleotide
ugggcuggcaguguauuuucaagcaga

SEQ ID NO: 7272 - RNA, 27 nt, Artificial Sequence
  Synthetic oligonucleotide
cugggcuggcaguguauuuucaagcag

SEQ ID NO: 7273 - RNA, 27 nt, Artificial Sequence
  Synthetic oligonucleotide
ucugggcuggcaguguauuuucaagca

SEQ ID NO: 7274 - RNA, 27 nt, Artificial Sequence
  Synthetic oligonucleotide
cucugggcuggcaguguauuuucaagc

SEQ ID NO: 7275 - RNA, 27 nt, Artificial Sequence
  Synthetic oligonucleotide
gcucugggcuggcaguguauuuucaag

SEQ ID NO: 7276 - RNA, 27 nt, Artificial Sequence
  Synthetic oligonucleotide
ugcucugggcuggcaguguauuuucaa

SEQ ID NO: 7277 - RNA, 27 nt, Artificial Sequence
  Synthetic oligonucleotide
gugcucugggcuggcaguguauuuuca

SEQ ID NO: 7278 - RNA, 27 nt, Artificial Sequence
  Synthetic oligonucleotide
ggugcucugggcuggcaguguauuuuc

SEQ ID NO: 7279 - RNA, 27 nt, Artificial Sequence
  Synthetic oligonucleotide
aggugcucugggcuggcaguguauuuu

SEQ ID NO: 7280 - RNA, 27 nt, Artificial Sequence
  Synthetic oligonucleotide
aaggugcucugggcuggcaguguauuu

SEQ ID NO: 7281 - RNA, 27 nt, Artificial Sequence
  Synthetic oligonucleotide
aaaggugcucugggcuggcaguguauu

SEQ ID NO: 7282 - RNA, 27 nt, Artificial Sequence
  Synthetic oligonucleotide
uaaaggugcucugggcuggcaguguau

SEQ ID NO: 7283 - RNA, 27 nt, Artificial Sequence
  Synthetic oligonucleotide
guaaaggugcucugggcuggcagugua

SEQ ID NO: 7284 - RNA, 27 nt, Artificial Sequence
  Synthetic oligonucleotide
uguaaaggugcucugggcuggcagugu

SEQ ID NO: 7285 - RNA, 27 nt, Artificial Sequence
  Synthetic oligonucleotide
auguaaaggugcucugggcuggcagug

SEQ ID NO: 7286 - RNA, 27 nt, Artificial Sequence
  Synthetic oligonucleotide
aauguaaaggugcucugggcuggcagu

SEQ ID NO: 7287 - RNA, 27 nt, Artificial Sequence
  Synthetic oligonucleotide
caauguaaaggugcucugggcuggcag

SEQ ID NO: 7288 - RNA, 27 nt, Artificial Sequence
  Synthetic oligonucleotide
ccaauguaaaggugcucugggcuggca

SEQ ID NO: 7289 - RNA, 27 nt, Artificial Sequence
  Synthetic oligonucleotide
gccaauguaaaggugcucugggcuggc

SEQ ID NO: 7290 - RNA, 27 nt, Artificial Sequence
  Synthetic oligonucleotide
ggccaauguaaaggugcucugggcugg

SEQ ID NO: 7291 - RNA, 27 nt, Artificial Sequence
  Synthetic oligonucleotide
uggccaauguaaaggugcucugggcug

SEQ ID NO: 7292 - RNA, 27 nt, Artificial Sequence
  Synthetic oligonucleotide
auggccaauguaaaggugcucugggcu

SEQ ID NO: 7293 - RNA, 27 nt, Artificial Sequence
  Synthetic oligonucleotide
aauggccaauguaaaggugcucugggc

SEQ ID NO: 7294 - RNA, 27 nt, Artificial Sequence
  Synthetic oligonucleotide
aaauggccaauguaaaggugcucuggg

SEQ ID NO: 7295 - RNA, 27 nt, Artificial Sequence
  Synthetic oligonucleotide
gaaauggccaauguaaaggugcucugg

SEQ ID NO: 7296 - RNA, 27 nt, Artificial Sequence
  Synthetic oligonucleotide
agaaauggccaauguaaaggugcucug

SEQ ID NO: 7297 - RNA, 27 nt, Artificial Sequence
  Synthetic oligonucleotide
cagaaauggccaauguaaaggugcucu

SEQ ID NO: 7298 - RNA, 27 nt, Artificial Sequence
  Synthetic oligonucleotide
gcagaaauggccaauguaaaggugcuc

SEQ ID NO: 7299 - RNA, 27 nt, Artificial Sequence
  Synthetic oligonucleotide
cgcagaaauggccaauguaaaggugcu

SEQ ID NO: 7300 - RNA, 27 nt, Artificial Sequence
  Synthetic oligonucleotide
acgcagaaauggccaauguaaaggugc

SEQ ID NO: 7301 - RNA, 27 nt, Artificial Sequence
  Synthetic oligonucleotide
uacgcagaaauggccaauguaaaggug

SEQ ID NO: 7302 - RNA, 27 nt, Artificial Sequence
  Synthetic oligonucleotide
auacgcagaaauggccaauguaaaggu

SEQ ID NO: 7303 - RNA, 27 nt, Artificial Sequence
  Synthetic oligonucleotide
cauacgcagaaauggccaauguaaagg

SEQ ID NO: 7304 - RNA, 27 nt, Artificial Sequence
  Synthetic oligonucleotide
gcauacgcagaaauggccaauguaaag

SEQ ID NO: 7305 - RNA, 27 nt, Artificial Sequence
  Synthetic oligonucleotide
uuuuaucucccagggaaagagcauacg

SEQ ID NO: 7306 - RNA, 27 nt, Artificial Sequence
  Synthetic oligonucleotide
guuuuaucucccagggaaagagcauac

SEQ ID NO: 7307 - RNA, 27 nt, Artificial Sequence
  Synthetic oligonucleotide
aguuuuaucucccagggaaagagcaua

SEQ ID NO: 7308 - RNA, 27 nt, Artificial Sequence
  Synthetic oligonucleotide
gaguuuuaucucccagggaaagagcau

SEQ ID NO: 7309 - RNA, 27 nt, Artificial Sequence
  Synthetic oligonucleotide
ugaguuuuaucucccagggaaagagca

SEQ ID NO: 7310 - RNA, 27 nt, Artificial Sequence
  Synthetic oligonucleotide
gugaguuuuaucucccagggaaagagc

SEQ ID NO: 7311 - RNA, 27 nt, Artificial Sequence
  Synthetic oligonucleotide
ggugaguuuuaucucccagggaaagag

SEQ ID NO: 7312 - RNA, 27 nt, Artificial Sequence
  Synthetic oligonucleotide
gggugaguuuuaucucccagggaaaga

SEQ ID NO: 7313 - RNA, 27 nt, Artificial Sequence
  Synthetic oligonucleotide
ugggugaguuuuaucucccagggaaag

SEQ ID NO: 7314 - RNA, 27 nt, Artificial Sequence
  Synthetic oligonucleotide
gugggugaguuuuaucucccagggaaa

SEQ ID NO: 7315 - RNA, 27 nt, Artificial Sequence
  Synthetic oligonucleotide
ugugggugaguuuuaucucccagggaa

SEQ ID NO: 7316 - RNA, 27 nt, Artificial Sequence
  Synthetic oligonucleotide
cugugggugaguuuuaucucccaggga

SEQ ID NO: 7317 - RNA, 27 nt, Artificial Sequence
  Synthetic oligonucleotide
acugugggugaguuuuaucucccaggg

SEQ ID NO: 7318 - RNA, 27 nt, Artificial Sequence
  Synthetic oligonucleotide
aacugugggugaguuuuaucucccagg

SEQ ID NO: 7319 - RNA, 27 nt, Artificial Sequence
  Synthetic oligonucleotide
aaacugugggugaguuuuaucucccag

SEQ ID NO: 7320 - RNA, 27 nt, Artificial Sequence
  Synthetic oligonucleotide
gaaacugugggugaguuuuaucuccca

SEQ ID NO: 7321 - RNA, 27 nt, Artificial Sequence
  Synthetic oligonucleotide
cgaaacugugggugaguuuuaucuccc

SEQ ID NO: 7322 - RNA, 27 nt, Artificial Sequence
  Synthetic oligonucleotide
acgaaacugugggugaguuuuaucucc

SEQ ID NO: 7323 - RNA, 27 nt, Artificial Sequence
  Synthetic oligonucleotide
aacgaaacugugggugaguuuuaucuc

SEQ ID NO: 7324 - RNA, 27 nt, Artificial Sequence
  Synthetic oligonucleotide
gaacgaaacugugggugaguuuuaucu

SEQ ID NO: 7325 - RNA, 27 nt, Artificial Sequence
  Synthetic oligonucleotide
ugaacgaaacugugggugaguuuuauc

SEQ ID NO: 7326 - RNA, 27 nt, Artificial Sequence
  Synthetic oligonucleotide
cucuucaaagcugaaacaauugaacga

SEQ ID NO: 7327 - RNA, 27 nt, Artificial Sequence
  Synthetic oligonucleotide
cucucuucaaagcugaaacaauugaac

SEQ ID NO: 7328 - RNA, 27 nt, Artificial Sequence
  Synthetic oligonucleotide
ucucucuucaaagcugaaacaauugaa

SEQ ID NO: 7329 - RNA, 27 nt, Artificial Sequence
  Synthetic oligonucleotide
uucucucuucaaagcugaaacaauuga

SEQ ID NO: 7330 - RNA, 27 nt, Artificial Sequence
  Synthetic oligonucleotide
cuucucucuucaaagcugaaacaauug

SEQ ID NO: 7331 - RNA, 27 nt, Artificial Sequence
  Synthetic oligonucleotide
gcuucucucuucaaagcugaaacaauu

SEQ ID NO: 7332 - RNA, 27 nt, Artificial Sequence
  Synthetic oligonucleotide
agcuucucucuucaaagcugaaacaau

SEQ ID NO: 7333 - RNA, 27 nt, Artificial Sequence
  Synthetic oligonucleotide
aagcuucucucuucaaagcugaaacaa

SEQ ID NO: 7334 - RNA, 27 nt, Artificial Sequence
  Synthetic oligonucleotide
aaagcuucucucuucaaagcugaaaca

SEQ ID NO: 7335 - RNA, 27 nt, Artificial Sequence
  Synthetic oligonucleotide
caaagcuucucucuucaaagcugaaac

SEQ ID NO: 7336 - RNA, 27 nt, Artificial Sequence
  Synthetic oligonucleotide
ccaaagcuucucucuucaaagcugaaa

SEQ ID NO: 7337 - RNA, 27 nt, Artificial Sequence
  Synthetic oligonucleotide
accaaagcuucucucuucaaagcugaa

SEQ ID NO: 7338 - RNA, 27 nt, Artificial Sequence
  Synthetic oligonucleotide
aaccaaagcuucucucuucaaagcuga

SEQ ID NO: 7339 - RNA, 27 nt, Artificial Sequence
  Synthetic oligonucleotide
uaaccaaagcuucucucuucaaagcug

SEQ ID NO: 7340 - RNA, 27 nt, Artificial Sequence
  Synthetic oligonucleotide
uuaaccaaagcuucucucuucaaagcu

SEQ ID NO: 7341 - RNA, 27 nt, Artificial Sequence
  Synthetic oligonucleotide
uuuaaccaaagcuucucucuucaaagc

SEQ ID NO: 7342 - RNA, 27 nt, Artificial Sequence
  Synthetic oligonucleotide
cuuuaaccaaagcuucucucuucaaag

SEQ ID NO: 7343 - RNA, 27 nt, Artificial Sequence
  Synthetic oligonucleotide
ccuuuaaccaaagcuucucucuucaaa

SEQ ID NO: 7344 - RNA, 27 nt, Artificial Sequence
  Synthetic oligonucleotide
auuaccuuuaaccaaagcuucucucuu

SEQ ID NO: 7345 - RNA, 27 nt, Artificial Sequence
  Synthetic oligonucleotide
gauuaccuuuaaccaaagcuucucucu

SEQ ID NO: 7346 - RNA, 27 nt, Artificial Sequence
  Synthetic oligonucleotide
ggauuaccuuuaaccaaagcuucucuc

SEQ ID NO: 7347 - RNA, 27 nt, Artificial Sequence
  Synthetic oligonucleotide
gguggauuaccuuuaaccaaagcuucu

SEQ ID NO: 7348 - RNA, 27 nt, Artificial Sequence
  Synthetic oligonucleotide
ggguggauuaccuuuaaccaaagcuuc

SEQ ID NO: 7349 - RNA, 27 nt, Artificial Sequence
  Synthetic oligonucleotide
uggguggauuaccuuuaaccaaagcuu

SEQ ID NO: 7350 - RNA, 27 nt, Artificial Sequence
  Synthetic oligonucleotide
auggguggauuaccuuuaaccaaagcu

SEQ ID NO: 7351 - RNA, 27 nt, Artificial Sequence
  Synthetic oligonucleotide
aauggguggauuaccuuuaaccaaagc

SEQ ID NO: 7352 - RNA, 27 nt, Artificial Sequence
  Synthetic oligonucleotide
aaauggguggauuaccuuuaaccaaag

SEQ ID NO: 7353 - RNA, 27 nt, Artificial Sequence
  Synthetic oligonucleotide
uaaauggguggauuaccuuuaaccaaa

SEQ ID NO: 7354 - RNA, 27 nt, Artificial Sequence
  Synthetic oligonucleotide
auaaauggguggauuaccuuuaaccaa

SEQ ID NO: 7355 - RNA, 27 nt, Artificial Sequence
  Synthetic oligonucleotide
gauaaauggguggauuaccuuuaacca

SEQ ID NO: 7356 - RNA, 27 nt, Artificial Sequence
  Synthetic oligonucleotide
cgauaaauggguggauuaccuuuaacc

SEQ ID NO: 7357 - RNA, 27 nt, Artificial Sequence
  Synthetic oligonucleotide
acgauaaauggguggauuaccuuuaac

SEQ ID NO: 7358 - RNA, 27 nt, Artificial Sequence
  Synthetic oligonucleotide
aacgauaaauggguggauuaccuuuaa

SEQ ID NO: 7359 - RNA, 27 nt, Artificial Sequence
  Synthetic oligonucleotide
aaacgauaaauggguggauuaccuuua

SEQ ID NO: 7360 - RNA, 27 nt, Artificial Sequence
  Synthetic oligonucleotide
aaaacgauaaauggguggauuaccuuu

SEQ ID NO: 7361 - RNA, 27 nt, Artificial Sequence
  Synthetic oligonucleotide
aaaaacgauaaauggguggauuaccuu

SEQ ID NO: 7362 - RNA, 27 nt, Artificial Sequence
  Synthetic oligonucleotide
caaaaacgauaaauggguggauuaccu

SEQ ID NO: 7363 - RNA, 27 nt, Artificial Sequence
  Synthetic oligonucleotide
ccaaaaacgauaaauggguggauuacc

SEQ ID NO: 7364 - RNA, 27 nt, Artificial Sequence
  Synthetic oligonucleotide
uccaaaaacgauaaauggguggauuac

SEQ ID NO: 7365 - RNA, 27 nt, Artificial Sequence
  Synthetic oligonucleotide
uuccaaaaacgauaaauggguggauua

SEQ ID NO: 7366 - RNA, 27 nt, Artificial Sequence
  Synthetic oligonucleotide
uuuccaaaaacgauaaauggguggauu

SEQ ID NO: 7367 - RNA, 27 nt, Artificial Sequence
  Synthetic oligonucleotide
cuuuccaaaaacgauaaauggguggau

SEQ ID NO: 7368 - RNA, 27 nt, Artificial Sequence
  Synthetic oligonucleotide
ucuuuccaaaaacgauaaaugggugga

SEQ ID NO: 7369 - RNA, 27 nt, Artificial Sequence
  Synthetic oligonucleotide
gucuuuccaaaaacgauaaaugggugg

SEQ ID NO: 7370 - RNA, 27 nt, Artificial Sequence
  Synthetic oligonucleotide
ugucuuuccaaaaacgauaaaugggug

SEQ ID NO: 7371 - RNA, 27 nt, Artificial Sequence
  Synthetic oligonucleotide
auugucuuuccaaaaacgauaaauggg

SEQ ID NO: 7372 - RNA, 27 nt, Artificial Sequence
  Synthetic oligonucleotide
gauugucuuuccaaaaacgauaaaugg

SEQ ID NO: 7373 - RNA, 27 nt, Artificial Sequence
  Synthetic oligonucleotide
agauugucuuuccaaaaacgauaaaug

SEQ ID NO: 7374 - RNA, 27 nt, Artificial Sequence
  Synthetic oligonucleotide
aagauugucuuuccaaaaacgauaaau

SEQ ID NO: 7375 - RNA, 27 nt, Artificial Sequence
  Synthetic oligonucleotide
gaagauugucuuuccaaaaacgauaaa

SEQ ID NO: 7376 - RNA, 27 nt, Artificial Sequence
  Synthetic oligonucleotide
uguuagguacagagcugucuuuaugcu

SEQ ID NO: 7377 - RNA, 27 nt, Artificial Sequence
  Synthetic oligonucleotide
guguuagguacagagcugucuuuaugc

SEQ ID NO: 7378 - RNA, 27 nt, Artificial Sequence
  Synthetic oligonucleotide
aguguuagguacagagcugucuuuaug

SEQ ID NO: 7379 - RNA, 27 nt, Artificial Sequence
  Synthetic oligonucleotide
caguguuagguacagagcugucuuuau

SEQ ID NO: 7380 - RNA, 27 nt, Artificial Sequence
  Synthetic oligonucleotide
ccaguguuagguacagagcugucuuua

SEQ ID NO: 7381 - RNA, 27 nt, Artificial Sequence
  Synthetic oligonucleotide
accaguguuagguacagagcugucuuu

SEQ ID NO: 7382 - RNA, 27 nt, Artificial Sequence
  Synthetic oligonucleotide
uaccaguguuagguacagagcugucuu

SEQ ID NO: 7383 - RNA, 27 nt, Artificial Sequence
  Synthetic oligonucleotide
guaccaguguuagguacagagcugucu

SEQ ID NO: 7384 - RNA, 27 nt, Artificial Sequence
  Synthetic oligonucleotide
cguaccaguguuagguacagagcuguc

SEQ ID NO: 7385 - RNA, 27 nt, Artificial Sequence
  Synthetic oligonucleotide
ccguaccaguguuagguacagagcugu

SEQ ID NO: 7386 - RNA, 27 nt, Artificial Sequence
  Synthetic oligonucleotide
gccguaccaguguuagguacagagcug

SEQ ID NO: 7387 - RNA, 27 nt, Artificial Sequence
  Synthetic oligonucleotide
ugccguaccaguguuagguacagagcu

SEQ ID NO: 7388 - RNA, 27 nt, Artificial Sequence
  Synthetic oligonucleotide
gugccguaccaguguuagguacagagc

SEQ ID NO: 7389 - RNA, 27 nt, Artificial Sequence
  Synthetic oligonucleotide
cgugccguaccaguguuagguacagag

SEQ ID NO: 7390 - RNA, 27 nt, Artificial Sequence
  Synthetic oligonucleotide
aggcaguuguuucuaccauacgugccg

SEQ ID NO: 7391 - RNA, 27 nt, Artificial Sequence
  Synthetic oligonucleotide
uaggcaguuguuucuaccauacgugcc

SEQ ID NO: 7392 - RNA, 27 nt, Artificial Sequence
  Synthetic oligonucleotide
auaggcaguuguuucuaccauacgugc

SEQ ID NO: 7393 - RNA, 27 nt, Artificial Sequence
  Synthetic oligonucleotide
cauaggcaguuguuucuaccauacgug

SEQ ID NO: 7394 - RNA, 27 nt, Artificial Sequence
  Synthetic oligonucleotide
gcauaggcaguuguuucuaccauacgu

SEQ ID NO: 7395 - RNA, 27 nt, Artificial Sequence
  Synthetic oligonucleotide
agcauaggcaguuguuucuaccauacg

SEQ ID NO: 7396 - RNA, 27 nt, Artificial Sequence
  Synthetic oligonucleotide
aagcauaggcaguuguuucuaccauac

SEQ ID NO: 7397 - RNA, 27 nt, Artificial Sequence
  Synthetic oligonucleotide
aaagcauaggcaguuguuucuaccaua

SEQ ID NO: 7398 - RNA, 27 nt, Artificial Sequence
  Synthetic oligonucleotide
uaaagcauaggcaguuguuucuaccau

SEQ ID NO: 7399 - RNA, 27 nt, Artificial Sequence
  Synthetic oligonucleotide
guaaagcauaggcaguuguuucuacca

SEQ ID NO: 7400 - RNA, 27 nt, Artificial Sequence
  Synthetic oligonucleotide
aguaaagcauaggcaguuguuucuacc

SEQ ID NO: 7401 - RNA, 27 nt, Artificial Sequence
  Synthetic oligonucleotide
gaguaaagcauaggcaguuguuucuac

SEQ ID NO: 7402 - RNA, 27 nt, Artificial Sequence
  Synthetic oligonucleotide
ugaguaaagcauaggcaguuguuucua

SEQ ID NO: 7403 - RNA, 27 nt, Artificial Sequence
  Synthetic oligonucleotide
gugaguaaagcauaggcaguuguuucu

SEQ ID NO: 7404 - RNA, 27 nt, Artificial Sequence
  Synthetic oligonucleotide
ggugaguaaagcauaggcaguuguuuc

SEQ ID NO: 7405 - RNA, 27 nt, Artificial Sequence
  Synthetic oligonucleotide
uggugaguaaagcauaggcaguuguuu

SEQ ID NO: 7406 - RNA, 27 nt, Artificial Sequence
  Synthetic oligonucleotide
cuggugaguaaagcauaggcaguuguu

SEQ ID NO: 7407 - RNA, 27 nt, Artificial Sequence
  Synthetic oligonucleotide
acuggugaguaaagcauaggcaguugu

SEQ ID NO: 7408 - RNA, 27 nt, Artificial Sequence
  Synthetic oligonucleotide
gacuggugaguaaagcauaggcaguug

SEQ ID NO: 7409 - RNA, 27 nt, Artificial Sequence
  Synthetic oligonucleotide
agacuggugaguaaagcauaggcaguu

SEQ ID NO: 7410 - RNA, 27 nt, Artificial Sequence
  Synthetic oligonucleotide
cagacuggugaguaaagcauaggcagu

SEQ ID NO: 7411 - RNA, 27 nt, Artificial Sequence
  Synthetic oligonucleotide
ucagacuggugaguaaagcauaggcag

SEQ ID NO: 7412 - RNA, 27 nt, Artificial Sequence
  Synthetic oligonucleotide
uucagacuggugaguaaagcauaggca

SEQ ID NO: 7413 - RNA, 27 nt, Artificial Sequence
  Synthetic oligonucleotide
guucagacuggugaguaaagcauaggc

SEQ ID NO: 7414 - RNA, 27 nt, Artificial Sequence
  Synthetic oligonucleotide
aguucagacuggugaguaaagcauagg

SEQ ID NO: 7415 - RNA, 27 nt, Artificial Sequence
  Synthetic oligonucleotide
aaguucagacuggugaguaaagcauag

SEQ ID NO: 7416 - RNA, 27 nt, Artificial Sequence
  Synthetic oligonucleotide
caaguucagacuggugaguaaagcaua

SEQ ID NO: 7417 - RNA, 27 nt, Artificial Sequence
  Synthetic oligonucleotide
uuucaaguucagacuggugaguaaagc

SEQ ID NO: 7418 - RNA, 27 nt, Artificial Sequence
  Synthetic oligonucleotide
cuuucaaguucagacuggugaguaaag

SEQ ID NO: 7419 - RNA, 27 nt, Artificial Sequence
  Synthetic oligonucleotide
ucuuucaaguucagacuggugaguaaa

SEQ ID NO: 7420 - RNA, 27 nt, Artificial Sequence
  Synthetic oligonucleotide
aucuuucaaguucagacuggugaguaa

SEQ ID NO: 7421 - RNA, 27 nt, Artificial Sequence
  Synthetic oligonucleotide
auaucuuucaaguucagacuggugagu

SEQ ID NO: 7422 - RNA, 27 nt, Artificial Sequence
  Synthetic oligonucleotide
uauaucuuucaaguucagacuggugag

SEQ ID NO: 7423 - RNA, 27 nt, Artificial Sequence
  Synthetic oligonucleotide
uuauaucuuucaaguucagacugguga

SEQ ID NO: 7424 - RNA, 27 nt, Artificial Sequence
  Synthetic oligonucleotide
ugcucuucugauagccauuugaugacu

SEQ ID NO: 7425 - RNA, 27 nt, Artificial Sequence
  Synthetic oligonucleotide
cugcucuucugauagccauuugaugac

SEQ ID NO: 7426 - RNA, 27 nt, Artificial Sequence
  Synthetic oligonucleotide
ucugcucuucugauagccauuugauga

SEQ ID NO: 7427 - RNA, 27 nt, Artificial Sequence
  Synthetic oligonucleotide
cucugcucuucugauagccauuugaug

SEQ ID NO: 7428 - RNA, 27 nt, Artificial Sequence
  Synthetic oligonucleotide
ccucugcucuucugauagccauuugau

SEQ ID NO: 7429 - RNA, 27 nt, Artificial Sequence
  Synthetic oligonucleotide
accucugcucuucugauagccauuuga

SEQ ID NO: 7430 - RNA, 27 nt, Artificial Sequence
  Synthetic oligonucleotide
uaccucugcucuucugauagccauuug

SEQ ID NO: 7431 - RNA, 27 nt, Artificial Sequence
  Synthetic oligonucleotide
auaccucugcucuucugauagccauuu

SEQ ID NO: 7432 - RNA, 27 nt, Artificial Sequence
  Synthetic oligonucleotide
cauaccucugcucuucugauagccauu

SEQ ID NO: 7433 - RNA, 27 nt, Artificial Sequence
  Synthetic oligonucleotide
ccauaccucugcucuucugauagccau

SEQ ID NO: 7434 - RNA, 27 nt, Artificial Sequence
  Synthetic oligonucleotide
uccauaccucugcucuucugauagcca

SEQ ID NO: 7435 - RNA, 27 nt, Artificial Sequence
  Synthetic oligonucleotide
cuccauaccucugcucuucugauagcc

SEQ ID NO: 7436 - RNA, 27 nt, Artificial Sequence
  Synthetic oligonucleotide
ccuccauaccucugcucuucugauagc

SEQ ID NO: 7437 - RNA, 27 nt, Artificial Sequence
  Synthetic oligonucleotide
accuccauaccucugcucuucugauag

SEQ ID NO: 7438 - RNA, 27 nt, Artificial Sequence
  Synthetic oligonucleotide
caccuccauaccucugcucuucugaua

SEQ ID NO: 7439 - RNA, 27 nt, Artificial Sequence
  Synthetic oligonucleotide
ccaccuccauaccucugcucuucugau

SEQ ID NO: 7440 - RNA, 27 nt, Artificial Sequence
  Synthetic oligonucleotide
gccaccuccauaccucugcucuucuga

SEQ ID NO: 7441 - RNA, 27 nt, Artificial Sequence
  Synthetic oligonucleotide
aaagccaccuccauaccucugcucuuc

SEQ ID NO: 7442 - RNA, 27 nt, Artificial Sequence
  Synthetic oligonucleotide
aaaagccaccuccauaccucugcucuu

SEQ ID NO: 7443 - RNA, 27 nt, Artificial Sequence
  Synthetic oligonucleotide
uaaaagccaccuccauaccucugcucu

SEQ ID NO: 7444 - RNA, 27 nt, Artificial Sequence
  Synthetic oligonucleotide
auaaaagccaccuccauaccucugcuc

SEQ ID NO: 7445 - RNA, 27 nt, Artificial Sequence
  Synthetic oligonucleotide
aauaaaagccaccuccauaccucugcu

SEQ ID NO: 7446 - RNA, 27 nt, Artificial Sequence
  Synthetic oligonucleotide
gaauaaaagccaccuccauaccucugc

SEQ ID NO: 7447 - RNA, 27 nt, Artificial Sequence
  Synthetic oligonucleotide
ugaauaaaagccaccuccauaccucug

SEQ ID NO: 7448 - RNA, 27 nt, Artificial Sequence
  Synthetic oligonucleotide
uugaauaaaagccaccuccauaccucu

SEQ ID NO: 7449 - RNA, 27 nt, Artificial Sequence
  Synthetic oligonucleotide
guugaauaaaagccaccuccauaccuc

SEQ ID NO: 7450 - RNA, 27 nt, Artificial Sequence
  Synthetic oligonucleotide
gguugaauaaaagccaccuccauaccu

SEQ ID NO: 7451 - RNA, 27 nt, Artificial Sequence
  Synthetic oligonucleotide
ggguugaauaaaagccaccuccauacc

SEQ ID NO: 7452 - RNA, 27 nt, Artificial Sequence
  Synthetic oligonucleotide
uggguugaauaaaagccaccuccauac

SEQ ID NO: 7453 - RNA, 27 nt, Artificial Sequence
  Synthetic oligonucleotide
cuggguugaauaaaagccaccuccaua

SEQ ID NO: 7454 - RNA, 27 nt, Artificial Sequence
  Synthetic oligonucleotide
ccuggguugaauaaaagccaccuccau

SEQ ID NO: 7455 - RNA, 27 nt, Artificial Sequence
  Synthetic oligonucleotide
uccuggguugaauaaaagccaccucca

SEQ ID NO: 7456 - RNA, 27 nt, Artificial Sequence
  Synthetic oligonucleotide
guccuggguugaauaaaagccaccucc

SEQ ID NO: 7457 - RNA, 27 nt, Artificial Sequence
  Synthetic oligonucleotide
uguccuggguugaauaaaagccaccuc

SEQ ID NO: 7458 - RNA, 27 nt, Artificial Sequence
  Synthetic oligonucleotide
guguccuggguugaauaaaagccaccu

SEQ ID NO: 7459 - RNA, 27 nt, Artificial Sequence
  Synthetic oligonucleotide
aguuguuuaaccaggagugaauauucc

SEQ ID NO: 7460 - RNA, 27 nt, Artificial Sequence
  Synthetic oligonucleotide
gaguuguuuaaccaggagugaauauuc

SEQ ID NO: 7461 - RNA, 27 nt, Artificial Sequence
  Synthetic oligonucleotide
ggaguuguuuaaccaggagugaauauu

SEQ ID NO: 7462 - RNA, 27 nt, Artificial Sequence
  Synthetic oligonucleotide
cggaguuguuuaaccaggagugaauau

SEQ ID NO: 7463 - RNA, 27 nt, Artificial Sequence
  Synthetic oligonucleotide
gucugucauuuuauaauuauguaaggc

SEQ ID NO: 7464 - RNA, 27 nt, Artificial Sequence
  Synthetic oligonucleotide
ugucugucauuuuauaauuauguaagg

SEQ ID NO: 7465 - RNA, 27 nt, Artificial Sequence
  Synthetic oligonucleotide
uugucugucauuuuauaauuauguaag

SEQ ID NO: 7466 - RNA, 27 nt, Artificial Sequence
  Synthetic oligonucleotide
cuugucugucauuuuauaauuauguaa

SEQ ID NO: 7467 - RNA, 27 nt, Artificial Sequence
  Synthetic oligonucleotide
ucuugucugucauuuuauaauuaugua

SEQ ID NO: 7468 - RNA, 27 nt, Artificial Sequence
  Synthetic oligonucleotide
uucuugucugucauuuuauaauuaugu

SEQ ID NO: 7469 - RNA, 27 nt, Artificial Sequence
  Synthetic oligonucleotide
auucuugucugucauuuuauaauuaug

SEQ ID NO: 7470 - RNA, 27 nt, Artificial Sequence
  Synthetic oligonucleotide
aauucuugucugucauuuuauaauuau

SEQ ID NO: 7471 - RNA, 27 nt, Artificial Sequence
  Synthetic oligonucleotide
aaauucuugucugucauuuuauaauua

SEQ ID NO: 7472 - RNA, 27 nt, Artificial Sequence
  Synthetic oligonucleotide
gaaauucuugucugucauuuuauaauu

SEQ ID NO: 7473 - RNA, 27 nt, Artificial Sequence
  Synthetic oligonucleotide
ggaaauucuugucugucauuuuauaau

SEQ ID NO: 7474 - RNA, 27 nt, Artificial Sequence
  Synthetic oligonucleotide
aggaaauucuugucugucauuuuauaa

SEQ ID NO: 7475 - RNA, 27 nt, Artificial Sequence
  Synthetic oligonucleotide
aaggaaauucuugucugucauuuuaua

SEQ ID NO: 7476 - RNA, 27 nt, Artificial Sequence
  Synthetic oligonucleotide
caaggaaauucuugucugucauuuuau

SEQ ID NO: 7477 - RNA, 27 nt, Artificial Sequence
  Synthetic oligonucleotide
ccaaggaaauucuugucugucauuuua

SEQ ID NO: 7478 - RNA, 27 nt, Artificial Sequence
  Synthetic oligonucleotide
cccaaggaaauucuugucugucauuuu

SEQ ID NO: 7479 - RNA, 27 nt, Artificial Sequence
  Synthetic oligonucleotide
ucccaaggaaauucuugucugucauuu

SEQ ID NO: 7480 - RNA, 27 nt, Artificial Sequence
  Synthetic oligonucleotide
cucccaaggaaauucuugucugucauu

SEQ ID NO: 7481 - RNA, 27 nt, Artificial Sequence
  Synthetic oligonucleotide
ccucccaaggaaauucuugucugucau

SEQ ID NO: 7482 - RNA, 27 nt, Artificial Sequence
  Synthetic oligonucleotide
gccucccaaggaaauucuugucuguca

SEQ ID NO: 7483 - RNA, 27 nt, Artificial Sequence
  Synthetic oligonucleotide
ggccucccaaggaaauucuugucuguc

SEQ ID NO: 7484 - RNA, 27 nt, Artificial Sequence
  Synthetic oligonucleotide
uggccucccaaggaaauucuugucugu

SEQ ID NO: 7485 - RNA, 27 nt, Artificial Sequence
  Synthetic oligonucleotide
cuggccucccaaggaaauucuugucug

SEQ ID NO: 7486 - RNA, 27 nt, Artificial Sequence
  Synthetic oligonucleotide
acuggccucccaaggaaauucuugucu

SEQ ID NO: 7487 - RNA, 27 nt, Artificial Sequence
  Synthetic oligonucleotide
uacuggccucccaaggaaauucuuguc

SEQ ID NO: 7488 - RNA, 27 nt, Artificial Sequence
  Synthetic oligonucleotide
cuacuggccucccaaggaaauucuugu

SEQ ID NO: 7489 - RNA, 27 nt, Artificial Sequence
  Synthetic oligonucleotide
ucuacuggccucccaaggaaauucuug

SEQ ID NO: 7490 - RNA, 27 nt, Artificial Sequence
  Synthetic oligonucleotide
cucuacuggccucccaaggaaauucuu

SEQ ID NO: 7491 - RNA, 27 nt, Artificial Sequence
  Synthetic oligonucleotide
gaagcaccucuacuggccucccaagga

SEQ ID NO: 7492 - RNA, 27 nt, Artificial Sequence
  Synthetic oligonucleotide
ugagaagcaccucuacuggccucccaa

SEQ ID NO: 7493 - RNA, 27 nt, Artificial Sequence
  Synthetic oligonucleotide
uugagaagcaccucuacuggccuccca

SEQ ID NO: 7494 - RNA, 27 nt, Artificial Sequence
  Synthetic oligonucleotide
auugagaagcaccucuacuggccuccc

SEQ ID NO: 7495 - RNA, 27 nt, Artificial Sequence
  Synthetic oligonucleotide
cauugagaagcaccucuacuggccucc

SEQ ID NO: 7496 - RNA, 27 nt, Artificial Sequence
  Synthetic oligonucleotide
ucauugagaagcaccucuacuggccuc

SEQ ID NO: 7497 - RNA, 27 nt, Artificial Sequence
  Synthetic oligonucleotide
aucauugagaagcaccucuacuggccu

SEQ ID NO: 7498 - RNA, 27 nt, Artificial Sequence
  Synthetic oligonucleotide
caucauugagaagcaccucuacuggcc

SEQ ID NO: 7499 - RNA, 27 nt, Artificial Sequence
  Synthetic oligonucleotide
ucaucauugagaagcaccucuacuggc

SEQ ID NO: 7500 - RNA, 27 nt, Artificial Sequence
  Synthetic oligonucleotide
gucaucauugagaagcaccucuacugg

SEQ ID NO: 7501 - RNA, 27 nt, Artificial Sequence
  Synthetic oligonucleotide
ggucaucauugagaagcaccucuacug

SEQ ID NO: 7502 - RNA, 27 nt, Artificial Sequence
  Synthetic oligonucleotide
aggucaucauugagaagcaccucuacu

SEQ ID NO: 7503 - RNA, 27 nt, Artificial Sequence
  Synthetic oligonucleotide
gaggucaucauugagaagcaccucuac

SEQ ID NO: 7504 - RNA, 27 nt, Artificial Sequence
  Synthetic oligonucleotide
ugaggucaucauugagaagcaccucua

SEQ ID NO: 7505 - RNA, 27 nt, Artificial Sequence
  Synthetic oligonucleotide
augaggucaucauugagaagcaccucu

SEQ ID NO: 7506 - RNA, 27 nt, Artificial Sequence
  Synthetic oligonucleotide
aaugaggucaucauugagaagcaccuc

SEQ ID NO: 7507 - RNA, 27 nt, Artificial Sequence
  Synthetic oligonucleotide
caaugaggucaucauugagaagcaccu

SEQ ID NO: 7508 - RNA, 27 nt, Artificial Sequence
  Synthetic oligonucleotide
acaaugaggucaucauugagaagcacc

SEQ ID NO: 7509 - RNA, 27 nt, Artificial Sequence
  Synthetic oligonucleotide
gacaaugaggucaucauugagaagcac

SEQ ID NO: 7510 - RNA, 27 nt, Artificial Sequence
  Synthetic oligonucleotide
ccacugccaaauccuguacugacaaug

SEQ ID NO: 7511 - RNA, 27 nt, Artificial Sequence
  Synthetic oligonucleotide
gccacugccaaauccuguacugacaau

SEQ ID NO: 7512 - RNA, 27 nt, Artificial Sequence
  Synthetic oligonucleotide
agccacugccaaauccuguacugacaa

SEQ ID NO: 7513 - RNA, 27 nt, Artificial Sequence
  Synthetic oligonucleotide
aagccacugccaaauccuguacugaca

SEQ ID NO: 7514 - RNA, 27 nt, Artificial Sequence
  Synthetic oligonucleotide
caagccacugccaaauccuguacugac

SEQ ID NO: 7515 - RNA, 27 nt, Artificial Sequence
  Synthetic oligonucleotide
ccaagccacugccaaauccuguacuga

SEQ ID NO: 7516 - RNA, 27 nt, Artificial Sequence
  Synthetic oligonucleotide
gccaagccacugccaaauccuguacug

SEQ ID NO: 7517 - RNA, 27 nt, Artificial Sequence
  Synthetic oligonucleotide
agccaagccacugccaaauccuguacu

SEQ ID NO: 7518 - RNA, 27 nt, Artificial Sequence
  Synthetic oligonucleotide
uagccaagccacugccaaauccuguac

SEQ ID NO: 7519 - RNA, 27 nt, Artificial Sequence
  Synthetic oligonucleotide
guagccaagccacugccaaauccugua

SEQ ID NO: 7520 - RNA, 27 nt, Artificial Sequence
  Synthetic oligonucleotide
uguagccaagccacugccaaauccugu

SEQ ID NO: 7521 - RNA, 27 nt, Artificial Sequence
  Synthetic oligonucleotide
acuguagccaagccacugccaaauccu

SEQ ID NO: 7522 - RNA, 27 nt, Artificial Sequence
  Synthetic oligonucleotide
uacuguagccaagccacugccaaaucc

SEQ ID NO: 7523 - RNA, 27 nt, Artificial Sequence
  Synthetic oligonucleotide
guacuguagccaagccacugccaaauc

SEQ ID NO: 7524 - RNA, 27 nt, Artificial Sequence
  Synthetic oligonucleotide
uguacuguagccaagccacugccaaau

SEQ ID NO: 7525 - RNA, 27 nt, Artificial Sequence
  Synthetic oligonucleotide
ugugaacuacaguuguuacauguacug

SEQ ID NO: 7526 - RNA, 27 nt, Artificial Sequence
  Synthetic oligonucleotide
uugugaacuacaguuguuacauguacu

SEQ ID NO: 7527 - RNA, 27 nt, Artificial Sequence
  Synthetic oligonucleotide
uuugugaacuacaguuguuacauguac

SEQ ID NO: 7528 - RNA, 27 nt, Artificial Sequence
  Synthetic oligonucleotide
guuuugugaacuacaguuguuacaugu

SEQ ID NO: 7529 - RNA, 27 nt, Artificial Sequence
  Synthetic oligonucleotide
gguuuugugaacuacaguuguuacaug

SEQ ID NO: 7530 - RNA, 27 nt, Artificial Sequence
  Synthetic oligonucleotide
ugguuuugugaacuacaguuguuacau

SEQ ID NO: 7531 - RNA, 27 nt, Artificial Sequence
  Synthetic oligonucleotide
cugguuuugugaacuacaguuguuaca

SEQ ID NO: 7532 - RNA, 27 nt, Artificial Sequence
  Synthetic oligonucleotide
acugguuuugugaacuacaguuguuac

SEQ ID NO: 7533 - RNA, 27 nt, Artificial Sequence
  Synthetic oligonucleotide
uacugguuuugugaacuacaguuguua

SEQ ID NO: 7534 - RNA, 27 nt, Artificial Sequence
  Synthetic oligonucleotide
guacugguuuugugaacuacaguuguu

SEQ ID NO: 7535 - RNA, 27 nt, Artificial Sequence
  Synthetic oligonucleotide
gguacugguuuugugaacuacaguugu

SEQ ID NO: 7536 - RNA, 27 nt, Artificial Sequence
  Synthetic oligonucleotide
agguacugguuuugugaacuacaguug

SEQ ID NO: 7537 - RNA, 27 nt, Artificial Sequence
  Synthetic oligonucleotide
gagguacugguuuugugaacuacaguu

SEQ ID NO: 7538 - RNA, 27 nt, Artificial Sequence
  Synthetic oligonucleotide
agagguacugguuuugugaacuacagu

SEQ ID NO: 7539 - RNA, 27 nt, Artificial Sequence
  Synthetic oligonucleotide
cagagguacugguuuugugaacuacag

SEQ ID NO: 7540 - RNA, 27 nt, Artificial Sequence
  Synthetic oligonucleotide
ucagagguacugguuuugugaacuaca

SEQ ID NO: 7541 - RNA, 27 nt, Artificial Sequence
  Synthetic oligonucleotide
cucagagguacugguuuugugaacuac

SEQ ID NO: 7542 - RNA, 27 nt, Artificial Sequence
  Synthetic oligonucleotide
ccucagagguacugguuuugugaacua

SEQ ID NO: 7543 - RNA, 27 nt, Artificial Sequence
  Synthetic oligonucleotide
uccucagagguacugguuuugugaacu

SEQ ID NO: 7544 - RNA, 27 nt, Artificial Sequence
  Synthetic oligonucleotide
uuccucagagguacugguuuugugaac

SEQ ID NO: 7545 - RNA, 27 nt, Artificial Sequence
  Synthetic oligonucleotide
cuuccucagagguacugguuuugugaa

SEQ ID NO: 7546 - RNA, 27 nt, Artificial Sequence
  Synthetic oligonucleotide
acuuccucagagguacugguuuuguga

SEQ ID NO: 7547 - RNA, 27 nt, Artificial Sequence
  Synthetic oligonucleotide
aacuuccucagagguacugguuuugug

SEQ ID NO: 7548 - RNA, 27 nt, Artificial Sequence
  Synthetic oligonucleotide
aaacuuccucagagguacugguuuugu

SEQ ID NO: 7549 - RNA, 27 nt, Artificial Sequence
  Synthetic oligonucleotide
caaacuuccucagagguacugguuuug

SEQ ID NO: 7550 - RNA, 27 nt, Artificial Sequence
  Synthetic oligonucleotide
gcaaacuuccucagagguacugguuuu

SEQ ID NO: 7551 - RNA, 27 nt, Artificial Sequence
  Synthetic oligonucleotide
ugcaaacuuccucagagguacugguuu

SEQ ID NO: 7552 - RNA, 27 nt, Artificial Sequence
  Synthetic oligonucleotide
cugcaaacuuccucagagguacugguu

SEQ ID NO: 7553 - RNA, 27 nt, Artificial Sequence
  Synthetic oligonucleotide
gcugcaaacuuccucagagguacuggu

SEQ ID NO: 7554 - RNA, 27 nt, Artificial Sequence
  Synthetic oligonucleotide
agcugcaaacuuccucagagguacugg

SEQ ID NO: 7555 - RNA, 27 nt, Artificial Sequence
  Synthetic oligonucleotide
aagcugcaaacuuccucagagguacug

SEQ ID NO: 7556 - RNA, 27 nt, Artificial Sequence
  Synthetic oligonucleotide
aaagcugcaaacuuccucagagguacu

SEQ ID NO: 7557 - RNA, 27 nt, Artificial Sequence
  Synthetic oligonucleotide
aaaagcugcaaacuuccucagagguac

SEQ ID NO: 7558 - RNA, 27 nt, Artificial Sequence
  Synthetic oligonucleotide
uaaaagcugcaaacuuccucagaggua

SEQ ID NO: 7559 - RNA, 27 nt, Artificial Sequence
  Synthetic oligonucleotide
auaaaagcugcaaacuuccucagaggu

SEQ ID NO: 7560 - RNA, 27 nt, Artificial Sequence
  Synthetic oligonucleotide
aauaaaagcugcaaacuuccucagagg

SEQ ID NO: 7561 - RNA, 27 nt, Artificial Sequence
  Synthetic oligonucleotide
aaauaaaagcugcaaacuuccucagag

SEQ ID NO: 7562 - RNA, 27 nt, Artificial Sequence
  Synthetic oligonucleotide
caaauaaaagcugcaaacuuccucaga

SEQ ID NO: 7563 - RNA, 27 nt, Artificial Sequence
  Synthetic oligonucleotide
aucgauuuucaaauaaaagcugcaaac

SEQ ID NO: 7564 - RNA, 27 nt, Artificial Sequence
  Synthetic oligonucleotide
uaucgauuuucaaauaaaagcugcaaa

SEQ ID NO: 7565 - RNA, 27 nt, Artificial Sequence
  Synthetic oligonucleotide
gggaugcuucaauauccugaguaucga

SEQ ID NO: 7566 - RNA, 27 nt, Artificial Sequence
  Synthetic oligonucleotide
gugggaugcuucaauauccugaguauc

SEQ ID NO: 7567 - RNA, 27 nt, Artificial Sequence
  Synthetic oligonucleotide
agugggaugcuucaauauccugaguau

SEQ ID NO: 7568 - RNA, 27 nt, Artificial Sequence
  Synthetic oligonucleotide
uagugggaugcuucaauauccugagua

SEQ ID NO: 7569 - RNA, 27 nt, Artificial Sequence
  Synthetic oligonucleotide
guagugggaugcuucaauauccugagu

SEQ ID NO: 7570 - RNA, 27 nt, Artificial Sequence
  Synthetic oligonucleotide
cuguagugggaugcuucaauauccuga

SEQ ID NO: 7571 - RNA, 27 nt, Artificial Sequence
  Synthetic oligonucleotide
ucuguagugggaugcuucaauauccug

SEQ ID NO: 7572 - RNA, 27 nt, Artificial Sequence
  Synthetic oligonucleotide
cucuguagugggaugcuucaauauccu

SEQ ID NO: 7573 - RNA, 27 nt, Artificial Sequence
  Synthetic oligonucleotide
ccucuguagugggaugcuucaauaucc

SEQ ID NO: 7574 - RNA, 27 nt, Artificial Sequence
  Synthetic oligonucleotide
gccucuguagugggaugcuucaauauc

SEQ ID NO: 7575 - RNA, 27 nt, Artificial Sequence
  Synthetic oligonucleotide
agccucuguagugggaugcuucaauau

SEQ ID NO: 7576 - RNA, 27 nt, Artificial Sequence
  Synthetic oligonucleotide
uagccucuguagugggaugcuucaaua

SEQ ID NO: 7577 - RNA, 27 nt, Artificial Sequence
  Synthetic oligonucleotide
guagccucuguagugggaugcuucaau

SEQ ID NO: 7578 - RNA, 27 nt, Artificial Sequence
  Synthetic oligonucleotide
cguagccucuguagugggaugcuucaa

SEQ ID NO: 7579 - RNA, 27 nt, Artificial Sequence
  Synthetic oligonucleotide
ccguagccucuguagugggaugcuuca

SEQ ID NO: 7580 - RNA, 27 nt, Artificial Sequence
  Synthetic oligonucleotide
uccguagccucuguagugggaugcuuc

SEQ ID NO: 7581 - RNA, 27 nt, Artificial Sequence
  Synthetic oligonucleotide
uuccguagccucuguagugggaugcuu

SEQ ID NO: 7582 - RNA, 27 nt, Artificial Sequence
  Synthetic oligonucleotide
uuuccguagccucuguagugggaugcu

SEQ ID NO: 7583 - RNA, 27 nt, Artificial Sequence
  Synthetic oligonucleotide
guuuccguagccucuguagugggaugc

SEQ ID NO: 7584 - RNA, 27 nt, Artificial Sequence
  Synthetic oligonucleotide
aguuuccguagccucuguagugggaug

SEQ ID NO: 7585 - RNA, 27 nt, Artificial Sequence
  Synthetic oligonucleotide
gaguuuccguagccucuguagugggau

SEQ ID NO: 7586 - RNA, 27 nt, Artificial Sequence
  Synthetic oligonucleotide
agaguuuccguagccucuguaguggga

SEQ ID NO: 7587 - RNA, 27 nt, Artificial Sequence
  Synthetic oligonucleotide
cagaguuuccguagccucuguaguggg

SEQ ID NO: 7588 - RNA, 27 nt, Artificial Sequence
  Synthetic oligonucleotide
ucagaguuuccguagccucuguagugg

SEQ ID NO: 7589 - RNA, 27 nt, Artificial Sequence
  Synthetic oligonucleotide
aucagaguuuccguagccucuguagug

SEQ ID NO: 7590 - RNA, 27 nt, Artificial Sequence
  Synthetic oligonucleotide
aaucagaguuuccguagccucuguagu

SEQ ID NO: 7591 - RNA, 27 nt, Artificial Sequence
  Synthetic oligonucleotide
uaaucagaguuuccguagccucuguag

SEQ ID NO: 7592 - RNA, 27 nt, Artificial Sequence
  Synthetic oligonucleotide
guaaucagaguuuccguagccucugua

SEQ ID NO: 7593 - RNA, 27 nt, Artificial Sequence
  Synthetic oligonucleotide
uguaaucagaguuuccguagccucugu

SEQ ID NO: 7594 - RNA, 27 nt, Artificial Sequence
  Synthetic oligonucleotide
uuguaaucagaguuuccguagccucug

SEQ ID NO: 7595 - RNA, 27 nt, Artificial Sequence
  Synthetic oligonucleotide
uuuguaaucagaguuuccguagccucu

SEQ ID NO: 7596 - RNA, 27 nt, Artificial Sequence
  Synthetic oligonucleotide
guuuguaaucagaguuuccguagccuc

SEQ ID NO: 7597 - RNA, 27 nt, Artificial Sequence
  Synthetic oligonucleotide
cguuuguaaucagaguuuccguagccu

SEQ ID NO: 7598 - RNA, 27 nt, Artificial Sequence
  Synthetic oligonucleotide
gcguuuguaaucagaguuuccguagcc

SEQ ID NO: 7599 - RNA, 27 nt, Artificial Sequence
  Synthetic oligonucleotide
ugcguuuguaaucagaguuuccguagc

SEQ ID NO: 7600 - RNA, 27 nt, Artificial Sequence
  Synthetic oligonucleotide
augcguuuguaaucagaguuuccguag

SEQ ID NO: 7601 - RNA, 27 nt, Artificial Sequence
  Synthetic oligonucleotide
uaugcguuuguaaucagaguuuccgua

SEQ ID NO: 7602 - RNA, 27 nt, Artificial Sequence
  Synthetic oligonucleotide
cuaugcguuuguaaucagaguuuccgu

SEQ ID NO: 7603 - RNA, 27 nt, Artificial Sequence
  Synthetic oligonucleotide
acuaugcguuuguaaucagaguuuccg

SEQ ID NO: 7604 - RNA, 27 nt, Artificial Sequence
  Synthetic oligonucleotide
uacuaugcguuuguaaucagaguuucc

SEQ ID NO: 7605 - RNA, 27 nt, Artificial Sequence
  Synthetic oligonucleotide
cuacuaugcguuuguaaucagaguuuc

SEQ ID NO: 7606 - RNA, 27 nt, Artificial Sequence
  Synthetic oligonucleotide
gcuacuaugcguuuguaaucagaguuu

SEQ ID NO: 7607 - RNA, 27 nt, Artificial Sequence
  Synthetic oligonucleotide
ugcuacuaugcguuuguaaucagaguu

SEQ ID NO: 7608 - RNA, 27 nt, Artificial Sequence
  Synthetic oligonucleotide
augcuacuaugcguuuguaaucagagu

SEQ ID NO: 7609 - RNA, 27 nt, Artificial Sequence
  Synthetic oligonucleotide
caugcuacuaugcguuuguaaucagag

SEQ ID NO: 7610 - RNA, 27 nt, Artificial Sequence
  Synthetic oligonucleotide
acaugcuacuaugcguuuguaaucaga

SEQ ID NO: 7611 - RNA, 27 nt, Artificial Sequence
  Synthetic oligonucleotide
cacaugcuacuaugcguuuguaaucag

SEQ ID NO: 7612 - RNA, 27 nt, Artificial Sequence
  Synthetic oligonucleotide
gcacaugcuacuaugcguuuguaauca

SEQ ID NO: 7613 - RNA, 27 nt, Artificial Sequence
  Synthetic oligonucleotide
ggcacaugcuacuaugcguuuguaauc

SEQ ID NO: 7614 - RNA, 27 nt, Artificial Sequence
  Synthetic oligonucleotide
uggcacaugcuacuaugcguuuguaau

SEQ ID NO: 7615 - RNA, 27 nt, Artificial Sequence
  Synthetic oligonucleotide
cuggcacaugcuacuaugcguuuguaa

SEQ ID NO: 7616 - RNA, 27 nt, Artificial Sequence
  Synthetic oligonucleotide
gcuggcacaugcuacuaugcguuugua

SEQ ID NO: 7617 - RNA, 27 nt, Artificial Sequence
  Synthetic oligonucleotide
agcuggcacaugcuacuaugcguuugu

SEQ ID NO: 7618 - RNA, 27 nt, Artificial Sequence
  Synthetic oligonucleotide
uagcuggcacaugcuacuaugcguuug

SEQ ID NO: 7619 - RNA, 27 nt, Artificial Sequence
  Synthetic oligonucleotide
guagcuggcacaugcuacuaugcguuu

SEQ ID NO: 7620 - RNA, 27 nt, Artificial Sequence
  Synthetic oligonucleotide
uguagcuggcacaugcuacuaugcguu

SEQ ID NO: 7621 - RNA, 27 nt, Artificial Sequence
  Synthetic oligonucleotide
uuguagcuggcacaugcuacuaugcgu

SEQ ID NO: 7622 - RNA, 27 nt, Artificial Sequence
  Synthetic oligonucleotide
cuuguagcuggcacaugcuacuaugcg

SEQ ID NO: 7623 - RNA, 27 nt, Artificial Sequence
  Synthetic oligonucleotide
gcuuguagcuggcacaugcuacuaugc

SEQ ID NO: 7624 - RNA, 27 nt, Artificial Sequence
  Synthetic oligonucleotide
ggcuuguagcuggcacaugcuacuaug

SEQ ID NO: 7625 - RNA, 27 nt, Artificial Sequence
  Synthetic oligonucleotide
gggcuuguagcuggcacaugcuacuau

SEQ ID NO: 7626 - RNA, 27 nt, Artificial Sequence
  Synthetic oligonucleotide
ugggcuuguagcuggcacaugcuacua

SEQ ID NO: 7627 - RNA, 27 nt, Artificial Sequence
  Synthetic oligonucleotide
caguaggcaaggagauguccaucaccg

SEQ ID NO: 7628 - RNA, 27 nt, Artificial Sequence
  Synthetic oligonucleotide
ccaguaggcaaggagauguccaucacc

SEQ ID NO: 7629 - RNA, 27 nt, Artificial Sequence
  Synthetic oligonucleotide
uccaguaggcaaggagauguccaucac

SEQ ID NO: 7630 - RNA, 27 nt, Artificial Sequence
  Synthetic oligonucleotide
uuccaguaggcaaggagauguccauca

SEQ ID NO: 7631 - RNA, 27 nt, Artificial Sequence
  Synthetic oligonucleotide
auuccaguaggcaaggagauguccauc

SEQ ID NO: 7632 - RNA, 27 nt, Artificial Sequence
  Synthetic oligonucleotide
gauuccaguaggcaaggagauguccau

SEQ ID NO: 7633 - RNA, 27 nt, Artificial Sequence
  Synthetic oligonucleotide
ugauuccaguaggcaaggagaugucca

SEQ ID NO: 7634 - RNA, 27 nt, Artificial Sequence
  Synthetic oligonucleotide
cugauuccaguaggcaaggagaugucc

SEQ ID NO: 7635 - RNA, 27 nt, Artificial Sequence
  Synthetic oligonucleotide
acugauuccaguaggcaaggagauguc

SEQ ID NO: 7636 - RNA, 27 nt, Artificial Sequence
  Synthetic oligonucleotide
cacugauuccaguaggcaaggagaugu

SEQ ID NO: 7637 - RNA, 27 nt, Artificial Sequence
  Synthetic oligonucleotide
gcacugauuccaguaggcaaggagaug

SEQ ID NO: 7638 - RNA, 27 nt, Artificial Sequence
  Synthetic oligonucleotide
ugcacugauuccaguaggcaaggagau

SEQ ID NO: 7639 - RNA, 27 nt, Artificial Sequence
  Synthetic oligonucleotide
uugcacugauuccaguaggcaaggaga

SEQ ID NO: 7640 - RNA, 27 nt, Artificial Sequence
  Synthetic oligonucleotide
ggcuuuuaagucuucuucauuugcacu

SEQ ID NO: 7641 - RNA, 27 nt, Artificial Sequence
  Synthetic oligonucleotide
gggcuuuuaagucuucuucauuugcac

SEQ ID NO: 7642 - RNA, 27 nt, Artificial Sequence
  Synthetic oligonucleotide
agggcuuuuaagucuucuucauuugca

SEQ ID NO: 7643 - RNA, 27 nt, Artificial Sequence
  Synthetic oligonucleotide
aagggcuuuuaagucuucuucauuugc

SEQ ID NO: 7644 - RNA, 27 nt, Artificial Sequence
  Synthetic oligonucleotide
caagggcuuuuaagucuucuucauuug

SEQ ID NO: 7645 - RNA, 27 nt, Artificial Sequence
  Synthetic oligonucleotide
acaagggcuuuuaagucuucuucauuu

SEQ ID NO: 7646 - RNA, 27 nt, Artificial Sequence
  Synthetic oligonucleotide
auaguugauccaccccuuccacaaggg

SEQ ID NO: 7647 - RNA, 27 nt, Artificial Sequence
  Synthetic oligonucleotide
aauaguugauccaccccuuccacaagg

SEQ ID NO: 7648 - RNA, 27 nt, Artificial Sequence
  Synthetic oligonucleotide
cuuugauuugguaaucagugaauaguu

SEQ ID NO: 7649 - RNA, 27 nt, Artificial Sequence
  Synthetic oligonucleotide
ucuuugauuugguaaucagugaauagu

SEQ ID NO: 7650 - RNA, 27 nt, Artificial Sequence
  Synthetic oligonucleotide
guugcagaauaacauguccaucuuuga

SEQ ID NO: 7651 - RNA, 27 nt, Artificial Sequence
  Synthetic oligonucleotide
aguugcagaauaacauguccaucuuug

SEQ ID NO: 7652 - RNA, 27 nt, Artificial Sequence
  Synthetic oligonucleotide
caguugcagaauaacauguccaucuuu

SEQ ID NO: 7653 - RNA, 27 nt, Artificial Sequence
  Synthetic oligonucleotide
auucaguugcagaauaacauguccauc

SEQ ID NO: 7654 - RNA, 27 nt, Artificial Sequence
  Synthetic oligonucleotide
gaauucaguugcagaauaacaugucca

SEQ ID NO: 7655 - RNA, 27 nt, Artificial Sequence
  Synthetic oligonucleotide
aaucgaauucaguugcagaauaacaug

SEQ ID NO: 7656 - RNA, 27 nt, Artificial Sequence
  Synthetic oligonucleotide
gaaucgaauucaguugcagaauaacau

SEQ ID NO: 7657 - RNA, 27 nt, Artificial Sequence
  Synthetic oligonucleotide
ggaaucgaauucaguugcagaauaaca

SEQ ID NO: 7658 - RNA, 27 nt, Artificial Sequence
  Synthetic oligonucleotide
gggaaucgaauucaguugcagaauaac

SEQ ID NO: 7659 - RNA, 27 nt, Artificial Sequence
  Synthetic oligonucleotide
gaaacccaacuucaaagaguucaaaua

SEQ ID NO: 7660 - RNA, 27 nt, Artificial Sequence
  Synthetic oligonucleotide
agaaacccaacuucaaagaguucaaau

SEQ ID NO: 7661 - RNA, 27 nt, Artificial Sequence
  Synthetic oligonucleotide
gagaaacccaacuucaaagaguucaaa

SEQ ID NO: 7662 - RNA, 27 nt, Artificial Sequence
  Synthetic oligonucleotide
ugagaaacccaacuucaaagaguucaa

SEQ ID NO: 7663 - RNA, 27 nt, Artificial Sequence
  Synthetic oligonucleotide
cugagaaacccaacuucaaagaguuca

SEQ ID NO: 7664 - RNA, 27 nt, Artificial Sequence
  Synthetic oligonucleotide
acugagaaacccaacuucaaagaguuc

SEQ ID NO: 7665 - RNA, 27 nt, Artificial Sequence
  Synthetic oligonucleotide
gacugagaaacccaacuucaaagaguu

SEQ ID NO: 7666 - RNA, 27 nt, Artificial Sequence
  Synthetic oligonucleotide
ggacugagaaacccaacuucaaagagu

SEQ ID NO: 7667 - RNA, 27 nt, Artificial Sequence
  Synthetic oligonucleotide
cguacacugugaaaguggcaggacuga

SEQ ID NO: 7668 - RNA, 27 nt, Artificial Sequence
  Synthetic oligonucleotide
ucguacacugugaaaguggcaggacug

SEQ ID NO: 7669 - RNA, 27 nt, Artificial Sequence
  Synthetic oligonucleotide
uucguacacugugaaaguggcaggacu

SEQ ID NO: 7670 - RNA, 27 nt, Artificial Sequence
  Synthetic oligonucleotide
auucguacacugugaaaguggcaggac

SEQ ID NO: 7671 - RNA, 27 nt, Artificial Sequence
  Synthetic oligonucleotide
uauucguacacugugaaaguggcagga

SEQ ID NO: 7672 - RNA, 27 nt, Artificial Sequence
  Synthetic oligonucleotide
acuguuuaucuggucugugguauucgu

SEQ ID NO: 7673 - RNA, 27 nt, Artificial Sequence
  Synthetic oligonucleotide
cacuguuuaucuggucugugguauucg

SEQ ID NO: 7674 - RNA, 27 nt, Artificial Sequence
  Synthetic oligonucleotide
acacuguuuaucuggucugugguauuc

SEQ ID NO: 7675 - RNA, 27 nt, Artificial Sequence
  Synthetic oligonucleotide
uacacuguuuaucuggucugugguauu

SEQ ID NO: 7676 - RNA, 27 nt, Artificial Sequence
  Synthetic oligonucleotide
guacacuguuuaucuggucugugguau

SEQ ID NO: 7677 - RNA, 27 nt, Artificial Sequence
  Synthetic oligonucleotide
gguacacuguuuaucuggucuguggua

SEQ ID NO: 7678 - RNA, 27 nt, Artificial Sequence
  Synthetic oligonucleotide
ugguacacuguuuaucuggucuguggu

SEQ ID NO: 7679 - RNA, 27 nt, Artificial Sequence
  Synthetic oligonucleotide
augguacacuguuuaucuggucugugg

SEQ ID NO: 7680 - RNA, 27 nt, Artificial Sequence
  Synthetic oligonucleotide
caugguacacuguuuaucuggucugug

SEQ ID NO: 7681 - RNA, 27 nt, Artificial Sequence
  Synthetic oligonucleotide
acaugguacacuguuuaucuggucugu

SEQ ID NO: 7682 - RNA, 27 nt, Artificial Sequence
  Synthetic oligonucleotide
aacaugguacacuguuuaucuggucug

SEQ ID NO: 7683 - RNA, 27 nt, Artificial Sequence
  Synthetic oligonucleotide
aaacaugguacacuguuuaucuggucu

SEQ ID NO: 7684 - RNA, 27 nt, Artificial Sequence
  Synthetic oligonucleotide
aaaacaugguacacuguuuaucugguc

SEQ ID NO: 7685 - RNA, 27 nt, Artificial Sequence
  Synthetic oligonucleotide
uaaaacaugguacacuguuuaucuggu

SEQ ID NO: 7686 - RNA, 27 nt, Artificial Sequence
  Synthetic oligonucleotide
auaaaacaugguacacuguuuaucugg

SEQ ID NO: 7687 - RNA, 27 nt, Artificial Sequence
  Synthetic oligonucleotide
gcuauaaaacaugguacacuguuuauc

SEQ ID NO: 7688 - RNA, 27 nt, Artificial Sequence
  Synthetic oligonucleotide
gugcuauaaaacaugguacacuguuua

SEQ ID NO: 7689 - RNA, 27 nt, Artificial Sequence
  Synthetic oligonucleotide
aagugcuauaaaacaugguacacuguu

SEQ ID NO: 7690 - RNA, 27 nt, Artificial Sequence
  Synthetic oligonucleotide
gaagugcuauaaaacaugguacacugu

SEQ ID NO: 7691 - RNA, 27 nt, Artificial Sequence
  Synthetic oligonucleotide
ggaagugcuauaaaacaugguacacug

SEQ ID NO: 7692 - RNA, 27 nt, Artificial Sequence
  Synthetic oligonucleotide
uggaagugcuauaaaacaugguacacu

SEQ ID NO: 7693 - RNA, 27 nt, Artificial Sequence
  Synthetic oligonucleotide
uuggaagugcuauaaaacaugguacac

SEQ ID NO: 7694 - RNA, 27 nt, Artificial Sequence
  Synthetic oligonucleotide
auuggaagugcuauaaaacaugguaca

SEQ ID NO: 7695 - RNA, 27 nt, Artificial Sequence
  Synthetic oligonucleotide
uauuggaagugcuauaaaacaugguac

SEQ ID NO: 7696 - RNA, 27 nt, Artificial Sequence
  Synthetic oligonucleotide
auauuggaagugcuauaaaacauggua

SEQ ID NO: 7697 - RNA, 27 nt, Artificial Sequence
  Synthetic oligonucleotide
gauauuggaagugcuauaaaacauggu

SEQ ID NO: 7698 - RNA, 27 nt, Artificial Sequence
  Synthetic oligonucleotide
ugauauuggaagugcuauaaaacaugg

SEQ ID NO: 7699 - RNA, 27 nt, Artificial Sequence
  Synthetic oligonucleotide
uugauauuggaagugcuauaaaacaug

SEQ ID NO: 7700 - RNA, 27 nt, Artificial Sequence
  Synthetic oligonucleotide
uuugauauuggaagugcuauaaaacau

SEQ ID NO: 7701 - RNA, 27 nt, Artificial Sequence
  Synthetic oligonucleotide
uuuugauauuggaagugcuauaaaaca

SEQ ID NO: 7702 - RNA, 27 nt, Artificial Sequence
  Synthetic oligonucleotide
auuuugauauuggaagugcuauaaaac

SEQ ID NO: 7703 - RNA, 27 nt, Artificial Sequence
  Synthetic oligonucleotide
aauuuugauauuggaagugcuauaaaa

SEQ ID NO: 7704 - RNA, 27 nt, Artificial Sequence
  Synthetic oligonucleotide
gaauuuugauauuggaagugcuauaaa

SEQ ID NO: 7705 - RNA, 27 nt, Artificial Sequence
  Synthetic oligonucleotide
cugaauuuugauauuggaagugcuaua

SEQ ID NO: 7706 - RNA, 27 nt, Artificial Sequence
  Synthetic oligonucleotide
ucugaauuuugauauuggaagugcuau

SEQ ID NO: 7707 - RNA, 27 nt, Artificial Sequence
  Synthetic oligonucleotide
uucugaauuuugauauuggaagugcua

SEQ ID NO: 7708 - RNA, 27 nt, Artificial Sequence
  Synthetic oligonucleotide
uuucugaauuuugauauuggaagugcu

SEQ ID NO: 7709 - RNA, 27 nt, Artificial Sequence
  Synthetic oligonucleotide
cuuucugaauuuugauauuggaagugc

SEQ ID NO: 7710 - RNA, 27 nt, Artificial Sequence
  Synthetic oligonucleotide
acuuucugaauuuugauauuggaagug

SEQ ID NO: 7711 - RNA, 27 nt, Artificial Sequence
  Synthetic oligonucleotide
gacuuucugaauuuugauauuggaagu

SEQ ID NO: 7712 - RNA, 27 nt, Artificial Sequence
  Synthetic oligonucleotide
agacuuucugaauuuugauauuggaag

SEQ ID NO: 7713 - RNA, 27 nt, Artificial Sequence
  Synthetic oligonucleotide
cagacuuucugaauuuugauauuggaa

SEQ ID NO: 7714 - RNA, 27 nt, Artificial Sequence
  Synthetic oligonucleotide
acagacuuucugaauuuugauauugga

SEQ ID NO: 7715 - RNA, 27 nt, Artificial Sequence
  Synthetic oligonucleotide
cacagacuuucugaauuuugauauugg

SEQ ID NO: 7716 - RNA, 27 nt, Artificial Sequence
  Synthetic oligonucleotide
ucacagacuuucugaauuuugauauug

SEQ ID NO: 7717 - RNA, 27 nt, Artificial Sequence
  Synthetic oligonucleotide
uucacagacuuucugaauuuugauauu

SEQ ID NO: 7718 - RNA, 27 nt, Artificial Sequence
  Synthetic oligonucleotide
cuucacagacuuucugaauuuugauau

SEQ ID NO: 7719 - RNA, 27 nt, Artificial Sequence
  Synthetic oligonucleotide
ccuucacagacuuucugaauuuugaua

SEQ ID NO: 7720 - RNA, 27 nt, Artificial Sequence
  Synthetic oligonucleotide
uccuucacagacuuucugaauuuugau

SEQ ID NO: 7721 - RNA, 27 nt, Artificial Sequence
  Synthetic oligonucleotide
cuccuucacagacuuucugaauuuuga

SEQ ID NO: 7722 - RNA, 27 nt, Artificial Sequence
  Synthetic oligonucleotide
gcuccuucacagacuuucugaauuuug

SEQ ID NO: 7723 - RNA, 27 nt, Artificial Sequence
  Synthetic oligonucleotide
ggcuccuucacagacuuucugaauuuu

SEQ ID NO: 7724 - RNA, 27 nt, Artificial Sequence
  Synthetic oligonucleotide
cggcuccuucacagacuuucugaauuu

SEQ ID NO: 7725 - RNA, 27 nt, Artificial Sequence
  Synthetic oligonucleotide
gcacgcggcuccuucacagacuuucug

SEQ ID NO: 7726 - RNA, 27 nt, Artificial Sequence
  Synthetic oligonucleotide
ugcauuugcccacaaucagcuucuaca

SEQ ID NO: 7727 - RNA, 27 nt, Artificial Sequence
  Synthetic oligonucleotide
cugcauuugcccacaaucagcuucuac

SEQ ID NO: 7728 - RNA, 27 nt, Artificial Sequence
  Synthetic oligonucleotide
ccugcauuugcccacaaucagcuucua

SEQ ID NO: 7729 - RNA, 27 nt, Artificial Sequence
  Synthetic oligonucleotide
uccugcauuugcccacaaucagcuucu

SEQ ID NO: 7730 - RNA, 27 nt, Artificial Sequence
  Synthetic oligonucleotide
uuccugcauuugcccacaaucagcuuc

SEQ ID NO: 7731 - RNA, 27 nt, Artificial Sequence
  Synthetic oligonucleotide
cuuccugcauuugcccacaaucagcuu

SEQ ID NO: 7732 - RNA, 27 nt, Artificial Sequence
  Synthetic oligonucleotide
ucuuccugcauuugcccacaaucagcu

SEQ ID NO: 7733 - RNA, 27 nt, Artificial Sequence
  Synthetic oligonucleotide
uucuuccugcauuugcccacaaucagc

SEQ ID NO: 7734 - RNA, 27 nt, Artificial Sequence
  Synthetic oligonucleotide
gcagagauugucagauccaauucuucc

SEQ ID NO: 7735 - RNA, 27 nt, Artificial Sequence
  Synthetic oligonucleotide
ugcagagauugucagauccaauucuuc

SEQ ID NO: 7736 - RNA, 27 nt, Artificial Sequence
  Synthetic oligonucleotide
cugcagagauugucagauccaauucuu

SEQ ID NO: 7737 - RNA, 27 nt, Artificial Sequence
  Synthetic oligonucleotide
ucugcagagauugucagauccaauucu

SEQ ID NO: 7738 - RNA, 27 nt, Artificial Sequence
  Synthetic oligonucleotide
cucugcagagauugucagauccaauuc

SEQ ID NO: 7739 - RNA, 27 nt, Artificial Sequence
  Synthetic oligonucleotide
ucucugcagagauugucagauccaauu

SEQ ID NO: 7740 - RNA, 27 nt, Artificial Sequence
  Synthetic oligonucleotide
gucucugcagagauugucagauccaau

SEQ ID NO: 7741 - RNA, 27 nt, Artificial Sequence
  Synthetic oligonucleotide
ugucucugcagagauugucagauccaa

SEQ ID NO: 7742 - RNA, 27 nt, Artificial Sequence
  Synthetic oligonucleotide
uugucucugcagagauugucagaucca

SEQ ID NO: 7743 - RNA, 27 nt, Artificial Sequence
  Synthetic oligonucleotide
cuugucucugcagagauugucagaucc

SEQ ID NO: 7744 - RNA, 27 nt, Artificial Sequence
  Synthetic oligonucleotide
ucuugucucugcagagauugucagauc

SEQ ID NO: 7745 - RNA, 27 nt, Artificial Sequence
  Synthetic oligonucleotide
uucuugucucugcagagauugucagau

SEQ ID NO: 7746 - RNA, 27 nt, Artificial Sequence
  Synthetic oligonucleotide
uuucuugucucugcagagauugucaga

SEQ ID NO: 7747 - RNA, 27 nt, Artificial Sequence
  Synthetic oligonucleotide
cugguuuacaugcuguuuguuuucuug

SEQ ID NO: 7748 - RNA, 27 nt, Artificial Sequence
  Synthetic oligonucleotide
ucugguuuacaugcuguuuguuuucuu

SEQ ID NO: 7749 - RNA, 27 nt, Artificial Sequence
  Synthetic oligonucleotide
gcuaacuuuauaagcauaugcaaucuc

SEQ ID NO: 7750 - RNA, 27 nt, Artificial Sequence
  Synthetic oligonucleotide
ugcuaacuuuauaagcauaugcaaucu

SEQ ID NO: 7751 - RNA, 27 nt, Artificial Sequence
  Synthetic oligonucleotide
augcuaacuuuauaagcauaugcaauc

SEQ ID NO: 7752 - RNA, 27 nt, Artificial Sequence
  Synthetic oligonucleotide
gaugcuaacuuuauaagcauaugcaau

SEQ ID NO: 7753 - RNA, 27 nt, Artificial Sequence
  Synthetic oligonucleotide
ugaugcuaacuuuauaagcauaugcaa

SEQ ID NO: 7754 - RNA, 27 nt, Artificial Sequence
  Synthetic oligonucleotide
guugccuuguacuugacaaaaacauuu

SEQ ID NO: 7755 - RNA, 27 nt, Artificial Sequence
  Synthetic oligonucleotide
gguugccuuguacuugacaaaaacauu

SEQ ID NO: 7756 - RNA, 27 nt, Artificial Sequence
  Synthetic oligonucleotide
ggguugccuuguacuugacaaaaacau

SEQ ID NO: 7757 - RNA, 27 nt, Artificial Sequence
  Synthetic oligonucleotide
aggguugccuuguacuugacaaaaaca

SEQ ID NO: 7758 - RNA, 27 nt, Artificial Sequence
  Synthetic oligonucleotide
aaggguugccuuguacuugacaaaaac

SEQ ID NO: 7759 - RNA, 27 nt, Artificial Sequence
  Synthetic oligonucleotide
gaaggguugccuuguacuugacaaaaa

SEQ ID NO: 7760 - RNA, 27 nt, Artificial Sequence
  Synthetic oligonucleotide
agaaggguugccuuguacuugacaaaa

SEQ ID NO: 7761 - RNA, 27 nt, Artificial Sequence
  Synthetic oligonucleotide
cagaaggguugccuuguacuugacaaa

SEQ ID NO: 7762 - RNA, 27 nt, Artificial Sequence
  Synthetic oligonucleotide
ccagaaggguugccuuguacuugacaa

SEQ ID NO: 7763 - RNA, 27 nt, Artificial Sequence
  Synthetic oligonucleotide
uccagaaggguugccuuguacuugaca

SEQ ID NO: 7764 - RNA, 27 nt, Artificial Sequence
  Synthetic oligonucleotide
auccagaaggguugccuuguacuugac

SEQ ID NO: 7765 - RNA, 27 nt, Artificial Sequence
  Synthetic oligonucleotide
uauccagaaggguugccuuguacuuga

SEQ ID NO: 7766 - RNA, 27 nt, Artificial Sequence
  Synthetic oligonucleotide
auauccagaaggguugccuuguacuug

SEQ ID NO: 7767 - RNA, 27 nt, Artificial Sequence
  Synthetic oligonucleotide
gauauccagaaggguugccuuguacuu

SEQ ID NO: 7768 - RNA, 27 nt, Artificial Sequence
  Synthetic oligonucleotide
agauauccagaaggguugccuuguacu

SEQ ID NO: 7769 - RNA, 27 nt, Artificial Sequence
  Synthetic oligonucleotide
uagauauccagaaggguugccuuguac

SEQ ID NO: 7770 - RNA, 27 nt, Artificial Sequence
  Synthetic oligonucleotide
guagauauccagaaggguugccuugua

SEQ ID NO: 7771 - RNA, 27 nt, Artificial Sequence
  Synthetic oligonucleotide
uguagauauccagaaggguugccuugu

SEQ ID NO: 7772 - RNA, 27 nt, Artificial Sequence
  Synthetic oligonucleotide
uuguagauauccagaaggguugccuug

SEQ ID NO: 7773 - RNA, 27 nt, Artificial Sequence
  Synthetic oligonucleotide
uuuguagauauccagaaggguugccuu

SEQ ID NO: 7774 - RNA, 27 nt, Artificial Sequence
  Synthetic oligonucleotide
uuuuguagauauccagaaggguugccu

SEQ ID NO: 7775 - RNA, 27 nt, Artificial Sequence
  Synthetic oligonucleotide
guuuuguagauauccagaaggguugcc

SEQ ID NO: 7776 - RNA, 27 nt, Artificial Sequence
  Synthetic oligonucleotide
aguuuuguagauauccagaaggguugc

SEQ ID NO: 7777 - RNA, 27 nt, Artificial Sequence
  Synthetic oligonucleotide
caguuuuguagauauccagaaggguug

SEQ ID NO: 7778 - RNA, 27 nt, Artificial Sequence
  Synthetic oligonucleotide
ccaguuuuguagauauccagaaggguu

SEQ ID NO: 7779 - RNA, 27 nt, Artificial Sequence
  Synthetic oligonucleotide
cccaguuuuguagauauccagaagggu

SEQ ID NO: 7780 - RNA, 27 nt, Artificial Sequence
  Synthetic oligonucleotide
ccccaguuuuguagauauccagaaggg

SEQ ID NO: 7781 - RNA, 27 nt, Artificial Sequence
  Synthetic oligonucleotide
uccccaguuuuguagauauccagaagg

SEQ ID NO: 7782 - RNA, 27 nt, Artificial Sequence
  Synthetic oligonucleotide
uuccccaguuuuguagauauccagaag

SEQ ID NO: 7783 - RNA, 27 nt, Artificial Sequence
  Synthetic oligonucleotide
cuuccccaguuuuguagauauccagaa

SEQ ID NO: 7784 - RNA, 27 nt, Artificial Sequence
  Synthetic oligonucleotide
gcuuccccaguuuuguagauauccaga

SEQ ID NO: 7785 - RNA, 27 nt, Artificial Sequence
  Synthetic oligonucleotide
agcuuccccaguuuuguagauauccag

SEQ ID NO: 7786 - RNA, 27 nt, Artificial Sequence
  Synthetic oligonucleotide
cagcuuccccaguuuuguagauaucca

SEQ ID NO: 7787 - RNA, 27 nt, Artificial Sequence
  Synthetic oligonucleotide
acagcuuccccaguuuuguagauaucc

SEQ ID NO: 7788 - RNA, 27 nt, Artificial Sequence
  Synthetic oligonucleotide
aacagcuuccccaguuuuguagauauc

SEQ ID NO: 7789 - RNA, 27 nt, Artificial Sequence
  Synthetic oligonucleotide
caacagcuuccccaguuuuguagauau

SEQ ID NO: 7790 - RNA, 27 nt, Artificial Sequence
  Synthetic oligonucleotide
gcaacagcuuccccaguuuuguagaua

SEQ ID NO: 7791 - RNA, 27 nt, Artificial Sequence
  Synthetic oligonucleotide
agcaacagcuuccccaguuuuguagau

SEQ ID NO: 7792 - RNA, 27 nt, Artificial Sequence
  Synthetic oligonucleotide
cagcaacagcuuccccaguuuuguaga

SEQ ID NO: 7793 - RNA, 27 nt, Artificial Sequence
  Synthetic oligonucleotide
ucagcaacagcuuccccaguuuuguag

SEQ ID NO: 7794 - RNA, 27 nt, Artificial Sequence
  Synthetic oligonucleotide
cucagcaacagcuuccccaguuuugua

SEQ ID NO: 7795 - RNA, 27 nt, Artificial Sequence
  Synthetic oligonucleotide
ucucagcaacagcuuccccaguuuugu

SEQ ID NO: 7796 - RNA, 27 nt, Artificial Sequence
  Synthetic oligonucleotide
uucucagcaacagcuuccccaguuuug

SEQ ID NO: 7797 - RNA, 27 nt, Artificial Sequence
  Synthetic oligonucleotide
uuucucagcaacagcuuccccaguuuu

SEQ ID NO: 7798 - RNA, 27 nt, Artificial Sequence
  Synthetic oligonucleotide
cuuucucagcaacagcuuccccaguuu

SEQ ID NO: 7799 - RNA, 27 nt, Artificial Sequence
  Synthetic oligonucleotide
ucuuucucagcaacagcuuccccaguu

SEQ ID NO: 7800 - RNA, 27 nt, Artificial Sequence
  Synthetic oligonucleotide
uacagguuaccuuuuuaaugaagguaa

SEQ ID NO: 7801 - RNA, 27 nt, Artificial Sequence
  Synthetic oligonucleotide
guacagguuaccuuuuuaaugaaggua

SEQ ID NO: 7802 - RNA, 27 nt, Artificial Sequence
  Synthetic oligonucleotide
aguacagguuaccuuuuuaaugaaggu

SEQ ID NO: 7803 - RNA, 27 nt, Artificial Sequence
  Synthetic oligonucleotide
uaguacagguuaccuuuuuaaugaagg

SEQ ID NO: 7804 - RNA, 27 nt, Artificial Sequence
  Synthetic oligonucleotide
uuaguacagguuaccuuuuuaaugaag

SEQ ID NO: 7805 - RNA, 27 nt, Artificial Sequence
  Synthetic oligonucleotide
ccauaauuaaguacugucuuccuuuua

SEQ ID NO: 7806 - RNA, 27 nt, Artificial Sequence
  Synthetic oligonucleotide
cccauaauuaaguacugucuuccuuuu

SEQ ID NO: 7807 - RNA, 27 nt, Artificial Sequence
  Synthetic oligonucleotide
acccauaauuaaguacugucuuccuuu

SEQ ID NO: 7808 - RNA, 27 nt, Artificial Sequence
  Synthetic oligonucleotide
uacccauaauuaaguacugucuuccuu

SEQ ID NO: 7809 - RNA, 27 nt, Artificial Sequence
  Synthetic oligonucleotide
uuacccauaauuaaguacugucuuccu

SEQ ID NO: 7810 - RNA, 27 nt, Artificial Sequence
  Synthetic oligonucleotide
uuuacccauaauuaaguacugucuucc

SEQ ID NO: 7811 - RNA, 27 nt, Artificial Sequence
  Synthetic oligonucleotide
cuuuacccauaauuaaguacugucuuc

SEQ ID NO: 7812 - RNA, 27 nt, Artificial Sequence
  Synthetic oligonucleotide
ucuuuacccauaauuaaguacugucuu

SEQ ID NO: 7813 - RNA, 27 nt, Artificial Sequence
  Synthetic oligonucleotide
aacugaaauuguauuuuaucuggaggg

SEQ ID NO: 7814 - RNA, 27 nt, Artificial Sequence
  Synthetic oligonucleotide
aaacugaaauuguauuuuaucuggagg

SEQ ID NO: 7815 - RNA, 27 nt, Artificial Sequence
  Synthetic oligonucleotide
ugaaacugaaauuguauuuuaucugga

SEQ ID NO: 7816 - RNA, 27 nt, Artificial Sequence
  Synthetic oligonucleotide
aucuaaaggguagauguaccugaaacu

SEQ ID NO: 7817 - RNA, 27 nt, Artificial Sequence
  Synthetic oligonucleotide
aaucuaaaggguagauguaccugaaac

SEQ ID NO: 7818 - RNA, 27 nt, Artificial Sequence
  Synthetic oligonucleotide
gaaucuaaaggguagauguaccugaaa

SEQ ID NO: 7819 - RNA, 27 nt, Artificial Sequence
  Synthetic oligonucleotide
ggaaucuaaaggguagauguaccugaa

SEQ ID NO: 7820 - RNA, 27 nt, Artificial Sequence
  Synthetic oligonucleotide
aggaaucuaaaggguagauguaccuga

SEQ ID NO: 7821 - RNA, 27 nt, Artificial Sequence
  Synthetic oligonucleotide
aaggaaucuaaaggguagauguaccug

SEQ ID NO: 7822 - RNA, 27 nt, Artificial Sequence
  Synthetic oligonucleotide
caaggaaucuaaaggguagauguaccu

SEQ ID NO: 7823 - RNA, 27 nt, Artificial Sequence
  Synthetic oligonucleotide
ucaaggaaucuaaaggguagauguacc

SEQ ID NO: 7824 - RNA, 27 nt, Artificial Sequence
  Synthetic oligonucleotide
gucaaggaaucuaaaggguagauguac

SEQ ID NO: 7825 - RNA, 27 nt, Artificial Sequence
  Synthetic oligonucleotide
ggucaaggaaucuaaaggguagaugua

SEQ ID NO: 7826 - RNA, 27 nt, Artificial Sequence
  Synthetic oligonucleotide
aggucaaggaaucuaaaggguagaugu

SEQ ID NO: 7827 - RNA, 27 nt, Artificial Sequence
  Synthetic oligonucleotide
caggucaaggaaucuaaaggguagaug

SEQ ID NO: 7828 - RNA, 27 nt, Artificial Sequence
  Synthetic oligonucleotide
ccaggucaaggaaucuaaaggguagau

SEQ ID NO: 7829 - RNA, 27 nt, Artificial Sequence
  Synthetic oligonucleotide
uccaggucaaggaaucuaaaggguaga

SEQ ID NO: 7830 - RNA, 27 nt, Artificial Sequence
  Synthetic oligonucleotide
auccaggucaaggaaucuaaaggguag

SEQ ID NO: 7831 - RNA, 27 nt, Artificial Sequence
  Synthetic oligonucleotide
aauccaggucaaggaaucuaaagggua

SEQ ID NO: 7832 - RNA, 27 nt, Artificial Sequence
  Synthetic oligonucleotide
caauccaggucaaggaaucuaaagggu

SEQ ID NO: 7833 - RNA, 27 nt, Artificial Sequence
  Synthetic oligonucleotide
ucaauccaggucaaggaaucuaaaggg

SEQ ID NO: 7834 - RNA, 27 nt, Artificial Sequence
  Synthetic oligonucleotide
uucaauccaggucaaggaaucuaaagg

SEQ ID NO: 7835 - RNA, 27 nt, Artificial Sequence
  Synthetic oligonucleotide
auucaauccaggucaaggaaucuaaag

SEQ ID NO: 7836 - RNA, 27 nt, Artificial Sequence
  Synthetic oligonucleotide
uauucaauccaggucaaggaaucuaaa

SEQ ID NO: 7837 - RNA, 27 nt, Artificial Sequence
  Synthetic oligonucleotide
guauucaauccaggucaaggaaucuaa

SEQ ID NO: 7838 - RNA, 27 nt, Artificial Sequence
  Synthetic oligonucleotide
aguauucaauccaggucaaggaaucua

SEQ ID NO: 7839 - RNA, 27 nt, Artificial Sequence
  Synthetic oligonucleotide
caguauucaauccaggucaaggaaucu

SEQ ID NO: 7840 - RNA, 27 nt, Artificial Sequence
  Synthetic oligonucleotide
ccaguauucaauccaggucaaggaauc

SEQ ID NO: 7841 - RNA, 27 nt, Artificial Sequence
  Synthetic oligonucleotide
gccaguauucaauccaggucaaggaau

SEQ ID NO: 7842 - RNA, 27 nt, Artificial Sequence
  Synthetic oligonucleotide
ggccaguauucaauccaggucaaggaa

SEQ ID NO: 7843 - RNA, 27 nt, Artificial Sequence
  Synthetic oligonucleotide
aggccaguauucaauccaggucaagga

SEQ ID NO: 7844 - RNA, 27 nt, Artificial Sequence
  Synthetic oligonucleotide
uaggccaguauucaauccaggucaagg

SEQ ID NO: 7845 - RNA, 27 nt, Artificial Sequence
  Synthetic oligonucleotide
cuaggccaguauucaauccaggucaag

SEQ ID NO: 7846 - RNA, 27 nt, Artificial Sequence
  Synthetic oligonucleotide
ucuaggccaguauucaauccaggucaa

SEQ ID NO: 7847 - RNA, 27 nt, Artificial Sequence
  Synthetic oligonucleotide
cucuaggccaguauucaauccagguca

SEQ ID NO: 7848 - RNA, 27 nt, Artificial Sequence
  Synthetic oligonucleotide
ucucuaggccaguauucaauccagguc

SEQ ID NO: 7849 - RNA, 27 nt, Artificial Sequence
  Synthetic oligonucleotide
gucucuaggccaguauucaauccaggu

SEQ ID NO: 7850 - RNA, 27 nt, Artificial Sequence
  Synthetic oligonucleotide
ugucucuaggccaguauucaauccagg

SEQ ID NO: 7851 - RNA, 27 nt, Artificial Sequence
  Synthetic oligonucleotide
gugucucuaggccaguauucaauccag

SEQ ID NO: 7852 - RNA, 27 nt, Artificial Sequence
  Synthetic oligonucleotide
aaugcuugacacgaugaacauguugug

SEQ ID NO: 7853 - RNA, 27 nt, Artificial Sequence
  Synthetic oligonucleotide
aaaugcuugacacgaugaacauguugu

SEQ ID NO: 7854 - RNA, 27 nt, Artificial Sequence
  Synthetic oligonucleotide
aaaaugcuugacacgaugaacauguug

SEQ ID NO: 7855 - RNA, 27 nt, Artificial Sequence
  Synthetic oligonucleotide
aaaaaugcuugacacgaugaacauguu

SEQ ID NO: 7856 - RNA, 27 nt, Artificial Sequence
  Synthetic oligonucleotide
cuaaaaaugcuugacacgaugaacaug

SEQ ID NO: 7857 - RNA, 27 nt, Artificial Sequence
  Synthetic oligonucleotide
gcuaaaaaugcuugacacgaugaacau

SEQ ID NO: 7858 - RNA, 27 nt, Artificial Sequence
  Synthetic oligonucleotide
agcuaaaaaugcuugacacgaugaaca

SEQ ID NO: 7859 - RNA, 27 nt, Artificial Sequence
  Synthetic oligonucleotide
uagcuaaaaaugcuugacacgaugaac

SEQ ID NO: 7860 - RNA, 27 nt, Artificial Sequence
  Synthetic oligonucleotide
auuagcuaaaaaugcuugacacgauga

SEQ ID NO: 7861 - RNA, 27 nt, Artificial Sequence
  Synthetic oligonucleotide
aauuagcuaaaaaugcuugacacgaug

SEQ ID NO: 7862 - RNA, 27 nt, Artificial Sequence
  Synthetic oligonucleotide
aaauuagcuaaaaaugcuugacacgau

SEQ ID NO: 7863 - RNA, 27 nt, Artificial Sequence
  Synthetic oligonucleotide
cuaaauuagcuaaaaaugcuugacacg

SEQ ID NO: 7864 - RNA, 27 nt, Artificial Sequence
  Synthetic oligonucleotide
ucuaaauuagcuaaaaaugcuugacac

SEQ ID NO: 7865 - RNA, 27 nt, Artificial Sequence
  Synthetic oligonucleotide
aucuaaauuagcuaaaaaugcuugaca

SEQ ID NO: 7866 - RNA, 27 nt, Artificial Sequence
  Synthetic oligonucleotide
caucuaaauuagcuaaaaaugcuugac

SEQ ID NO: 7867 - RNA, 27 nt, Artificial Sequence
  Synthetic oligonucleotide
uucaucuaaauuagcuaaaaaugcuug

SEQ ID NO: 7868 - RNA, 27 nt, Artificial Sequence
  Synthetic oligonucleotide
auucaucuaaauuagcuaaaaaugcuu

SEQ ID NO: 7869 - RNA, 27 nt, Artificial Sequence
  Synthetic oligonucleotide
aauucaucuaaauuagcuaaaaaugcu

SEQ ID NO: 7870 - RNA, 27 nt, Artificial Sequence
  Synthetic oligonucleotide
aaauucaucuaaauuagcuaaaaaugc

SEQ ID NO: 7871 - RNA, 27 nt, Artificial Sequence
  Synthetic oligonucleotide
caaauucaucuaaauuagcuaaaaaug

SEQ ID NO: 7872 - RNA, 27 nt, Artificial Sequence
  Synthetic oligonucleotide
gcaaauucaucuaaauuagcuaaaaau

SEQ ID NO: 7873 - RNA, 27 nt, Artificial Sequence
  Synthetic oligonucleotide
ggcaaauucaucuaaauuagcuaaaaa

SEQ ID NO: 7874 - RNA, 27 nt, Artificial Sequence
  Synthetic oligonucleotide
cggcaaauucaucuaaauuagcuaaaa

SEQ ID NO: 7875 - RNA, 27 nt, Artificial Sequence
  Synthetic oligonucleotide
ucggcaaauucaucuaaauuagcuaaa

SEQ ID NO: 7876 - RNA, 27 nt, Artificial Sequence
  Synthetic oligonucleotide
uucggcaaauucaucuaaauuagcuaa

SEQ ID NO: 7877 - RNA, 27 nt, Artificial Sequence
  Synthetic oligonucleotide
cuucggcaaauucaucuaaauuagcua

SEQ ID NO: 7878 - RNA, 27 nt, Artificial Sequence
  Synthetic oligonucleotide
ucuucggcaaauucaucuaaauuagcu

SEQ ID NO: 7879 - RNA, 27 nt, Artificial Sequence
  Synthetic oligonucleotide
aauuuuagcauccauuuaaaaagauau

SEQ ID NO: 7880 - RNA, 27 nt, Artificial Sequence
  Synthetic oligonucleotide
gaauuuuagcauccauuuaaaaagaua

SEQ ID NO: 7881 - RNA, 27 nt, Artificial Sequence
  Synthetic oligonucleotide
ggaauuuuagcauccauuuaaaaagau

SEQ ID NO: 7882 - RNA, 27 nt, Artificial Sequence
  Synthetic oligonucleotide
aggaauuuuagcauccauuuaaaaaga

SEQ ID NO: 7883 - RNA, 27 nt, Artificial Sequence
  Synthetic oligonucleotide
caggaauuuuagcauccauuuaaaaag

SEQ ID NO: 7884 - RNA, 27 nt, Artificial Sequence
  Synthetic oligonucleotide
ucaggaauuuuagcauccauuuaaaaa

SEQ ID NO: 7885 - RNA, 27 nt, Artificial Sequence
  Synthetic oligonucleotide
uucaggaauuuuagcauccauuuaaaa

SEQ ID NO: 7886 - RNA, 27 nt, Artificial Sequence
  Synthetic oligonucleotide
cuucaggaauuuuagcauccauuuaaa

SEQ ID NO: 7887 - RNA, 27 nt, Artificial Sequence
  Synthetic oligonucleotide
acuucaggaauuuuagcauccauuuaa

SEQ ID NO: 7888 - RNA, 27 nt, Artificial Sequence
  Synthetic oligonucleotide
aacuucaggaauuuuagcauccauuua

SEQ ID NO: 7889 - RNA, 27 nt, Artificial Sequence
  Synthetic oligonucleotide
gaacuucaggaauuuuagcauccauuu

SEQ ID NO: 7890 - RNA, 27 nt, Artificial Sequence
  Synthetic oligonucleotide
cugaacuucaggaauuuuagcauccau

SEQ ID NO: 7891 - RNA, 27 nt, Artificial Sequence
  Synthetic oligonucleotide
gcugaacuucaggaauuuuagcaucca

SEQ ID NO: 7892 - RNA, 27 nt, Artificial Sequence
  Synthetic oligonucleotide
agcugaacuucaggaauuuuagcaucc

SEQ ID NO: 7893 - RNA, 27 nt, Artificial Sequence
  Synthetic oligonucleotide
cagcugaacuucaggaauuuuagcauc

SEQ ID NO: 7894 - RNA, 27 nt, Artificial Sequence
  Synthetic oligonucleotide
gcagcugaacuucaggaauuuuagcau

SEQ ID NO: 7895 - RNA, 27 nt, Artificial Sequence
  Synthetic oligonucleotide
ugcagcugaacuucaggaauuuuagca

SEQ ID NO: 7896 - RNA, 27 nt, Artificial Sequence
  Synthetic oligonucleotide
augcagcugaacuucaggaauuuuagc

SEQ ID NO: 7897 - RNA, 27 nt, Artificial Sequence
  Synthetic oligonucleotide
uaugcagcugaacuucaggaauuuuag

SEQ ID NO: 7898 - RNA, 27 nt, Artificial Sequence
  Synthetic oligonucleotide
guaugcagcugaacuucaggaauuuua

SEQ ID NO: 7899 - RNA, 27 nt, Artificial Sequence
  Synthetic oligonucleotide
uguaugcagcugaacuucaggaauuuu

SEQ ID NO: 7900 - RNA, 27 nt, Artificial Sequence
  Synthetic oligonucleotide
cuguaugcagcugaacuucaggaauuu

SEQ ID NO: 7901 - RNA, 27 nt, Artificial Sequence
  Synthetic oligonucleotide
acuguaugcagcugaacuucaggaauu

SEQ ID NO: 7902 - RNA, 27 nt, Artificial Sequence
  Synthetic oligonucleotide
aacuguaugcagcugaacuucaggaau

SEQ ID NO: 7903 - RNA, 27 nt, Artificial Sequence
  Synthetic oligonucleotide
aaacuguaugcagcugaacuucaggaa

SEQ ID NO: 7904 - RNA, 27 nt, Artificial Sequence
  Synthetic oligonucleotide
caaacuguaugcagcugaacuucagga

SEQ ID NO: 7905 - RNA, 27 nt, Artificial Sequence
  Synthetic oligonucleotide
gcaaacuguaugcagcugaacuucagg

SEQ ID NO: 7906 - RNA, 27 nt, Artificial Sequence
  Synthetic oligonucleotide
ugcaaacuguaugcagcugaacuucag

SEQ ID NO: 7907 - RNA, 27 nt, Artificial Sequence
  Synthetic oligonucleotide
gugcaaacuguaugcagcugaacuuca

SEQ ID NO: 7908 - RNA, 27 nt, Artificial Sequence
  Synthetic oligonucleotide
agugcaaacuguaugcagcugaacuuc

SEQ ID NO: 7909 - RNA, 27 nt, Artificial Sequence
  Synthetic oligonucleotide
aagugcaaacuguaugcagcugaacuu

SEQ ID NO: 7910 - RNA, 27 nt, Artificial Sequence
  Synthetic oligonucleotide
uaagugcaaacuguaugcagcugaacu

SEQ ID NO: 7911 - RNA, 27 nt, Artificial Sequence
  Synthetic oligonucleotide
auaagugcaaacuguaugcagcugaac

SEQ ID NO: 7912 - RNA, 27 nt, Artificial Sequence
  Synthetic oligonucleotide
cauaagugcaaacuguaugcagcugaa

SEQ ID NO: 7913 - RNA, 27 nt, Artificial Sequence
  Synthetic oligonucleotide
ccauaagugcaaacuguaugcagcuga

SEQ ID NO: 7914 - RNA, 27 nt, Artificial Sequence
  Synthetic oligonucleotide
uccauaagugcaaacuguaugcagcug

SEQ ID NO: 7915 - RNA, 27 nt, Artificial Sequence
  Synthetic oligonucleotide
guccauaagugcaaacuguaugcagcu

SEQ ID NO: 7916 - RNA, 27 nt, Artificial Sequence
  Synthetic oligonucleotide
aguccauaagugcaaacuguaugcagc

SEQ ID NO: 7917 - RNA, 27 nt, Artificial Sequence
  Synthetic oligonucleotide
gaguccauaagugcaaacuguaugcag

SEQ ID NO: 7918 - RNA, 27 nt, Artificial Sequence
  Synthetic oligonucleotide
ggaguccauaagugcaaacuguaugca

SEQ ID NO: 7919 - RNA, 27 nt, Artificial Sequence
  Synthetic oligonucleotide
aggaguccauaagugcaaacuguaugc

SEQ ID NO: 7920 - RNA, 27 nt, Artificial Sequence
  Synthetic oligonucleotide
caggaguccauaagugcaaacuguaug

SEQ ID NO: 7921 - RNA, 27 nt, Artificial Sequence
  Synthetic oligonucleotide
acaggaguccauaagugcaaacuguau

SEQ ID NO: 7922 - RNA, 27 nt, Artificial Sequence
  Synthetic oligonucleotide
aacaggaguccauaagugcaaacugua

SEQ ID NO: 7923 - RNA, 27 nt, Artificial Sequence
  Synthetic oligonucleotide
caacaggaguccauaagugcaaacugu

SEQ ID NO: 7924 - RNA, 27 nt, Artificial Sequence
  Synthetic oligonucleotide
acaacaggaguccauaagugcaaacug

SEQ ID NO: 7925 - RNA, 27 nt, Artificial Sequence
  Synthetic oligonucleotide
aacaacaggaguccauaagugcaaacu

SEQ ID NO: 7926 - RNA, 27 nt, Artificial Sequence
  Synthetic oligonucleotide
caacaacaggaguccauaagugcaaac

SEQ ID NO: 7927 - RNA, 27 nt, Artificial Sequence
  Synthetic oligonucleotide
ucaacaacaggaguccauaagugcaaa

SEQ ID NO: 7928 - RNA, 27 nt, Artificial Sequence
  Synthetic oligonucleotide
uucaacaacaggaguccauaagugcaa

SEQ ID NO: 7929 - RNA, 27 nt, Artificial Sequence
  Synthetic oligonucleotide
cuucaacaacaggaguccauaagugca

SEQ ID NO: 7930 - RNA, 27 nt, Artificial Sequence
  Synthetic oligonucleotide
acuucaacaacaggaguccauaagugc

SEQ ID NO: 7931 - RNA, 27 nt, Artificial Sequence
  Synthetic oligonucleotide
aacuucaacaacaggaguccauaagug

SEQ ID NO: 7932 - RNA, 27 nt, Artificial Sequence
  Synthetic oligonucleotide
gaacuucaacaacaggaguccauaagu

SEQ ID NO: 7933 - RNA, 27 nt, Artificial Sequence
  Synthetic oligonucleotide
cgaacuucaacaacaggaguccauaag

SEQ ID NO: 7934 - RNA, 27 nt, Artificial Sequence
  Synthetic oligonucleotide
aacgaacuucaacaacaggaguccaua

SEQ ID NO: 7935 - RNA, 27 nt, Artificial Sequence
  Synthetic oligonucleotide
gugagcuuuacaaauaagaccagcuau

SEQ ID NO: 7936 - RNA, 27 nt, Artificial Sequence
  Synthetic oligonucleotide
agugagcuuuacaaauaagaccagcua

SEQ ID NO: 7937 - RNA, 27 nt, Artificial Sequence
  Synthetic oligonucleotide
aagugagcuuuacaaauaagaccagcu

SEQ ID NO: 7938 - RNA, 27 nt, Artificial Sequence
  Synthetic oligonucleotide
aaagugagcuuuacaaauaagaccagc

SEQ ID NO: 7939 - RNA, 27 nt, Artificial Sequence
  Synthetic oligonucleotide
uaaagugagcuuuacaaauaagaccag

SEQ ID NO: 7940 - RNA, 27 nt, Artificial Sequence
  Synthetic oligonucleotide
guaaagugagcuuuacaaauaagacca

SEQ ID NO: 7941 - RNA, 27 nt, Artificial Sequence
  Synthetic oligonucleotide
aguaaagugagcuuuacaaauaagacc

SEQ ID NO: 7942 - RNA, 27 nt, Artificial Sequence
  Synthetic oligonucleotide
aaguaaagugagcuuuacaaauaagac

SEQ ID NO: 7943 - RNA, 27 nt, Artificial Sequence
  Synthetic oligonucleotide
uaaguaaagugagcuuuacaaauaaga

SEQ ID NO: 7944 - RNA, 27 nt, Artificial Sequence
  Synthetic oligonucleotide
cuaaguaaagugagcuuuacaaauaag

SEQ ID NO: 7945 - RNA, 27 nt, Artificial Sequence
  Synthetic oligonucleotide
ucuaaguaaagugagcuuuacaaauaa

SEQ ID NO: 7946 - RNA, 27 nt, Artificial Sequence
  Synthetic oligonucleotide
uucuaaguaaagugagcuuuacaaaua

SEQ ID NO: 7947 - RNA, 27 nt, Artificial Sequence
  Synthetic oligonucleotide
auucuaaguaaagugagcuuuacaaau

SEQ ID NO: 7948 - RNA, 27 nt, Artificial Sequence
  Synthetic oligonucleotide
aauucuaaguaaagugagcuuuacaaa

SEQ ID NO: 7949 - RNA, 27 nt, Artificial Sequence
  Synthetic oligonucleotide
uaauucuaaguaaagugagcuuuacaa

SEQ ID NO: 7950 - RNA, 27 nt, Artificial Sequence
  Synthetic oligonucleotide
cuaauucuaaguaaagugagcuuuaca

SEQ ID NO: 7951 - RNA, 27 nt, Artificial Sequence
  Synthetic oligonucleotide
acuaauucuaaguaaagugagcuuuac

SEQ ID NO: 7952 - RNA, 27 nt, Artificial Sequence
  Synthetic oligonucleotide
cacuaauucuaaguaaagugagcuuua

SEQ ID NO: 7953 - RNA, 27 nt, Artificial Sequence
  Synthetic oligonucleotide
ccacuaauucuaaguaaagugagcuuu

SEQ ID NO: 7954 - RNA, 27 nt, Artificial Sequence
  Synthetic oligonucleotide
gccacuaauucuaaguaaagugagcuu

SEQ ID NO: 7955 - RNA, 27 nt, Artificial Sequence
  Synthetic oligonucleotide
ugccacuaauucuaaguaaagugagcu

SEQ ID NO: 7956 - RNA, 27 nt, Artificial Sequence
  Synthetic oligonucleotide
gugccacuaauucuaaguaaagugagc

SEQ ID NO: 7957 - RNA, 27 nt, Artificial Sequence
  Synthetic oligonucleotide
agugccacuaauucuaaguaaagugag

SEQ ID NO: 7958 - RNA, 27 nt, Artificial Sequence
  Synthetic oligonucleotide
aagugccacuaauucuaaguaaaguga

SEQ ID NO: 7959 - RNA, 27 nt, Artificial Sequence
  Synthetic oligonucleotide
caagugccacuaauucuaaguaaagug

SEQ ID NO: 7960 - RNA, 27 nt, Artificial Sequence
  Synthetic oligonucleotide
gcaagugccacuaauucuaaguaaagu

SEQ ID NO: 7961 - RNA, 27 nt, Artificial Sequence
  Synthetic oligonucleotide
agcaagugccacuaauucuaaguaaag

SEQ ID NO: 7962 - RNA, 27 nt, Artificial Sequence
  Synthetic oligonucleotide
aagcaagugccacuaauucuaaguaaa

SEQ ID NO: 7963 - RNA, 27 nt, Artificial Sequence
  Synthetic oligonucleotide
aaagcaagugccacuaauucuaaguaa

SEQ ID NO: 7964 - RNA, 27 nt, Artificial Sequence
  Synthetic oligonucleotide
aaaagcaagugccacuaauucuaagua

SEQ ID NO: 7965 - RNA, 27 nt, Artificial Sequence
  Synthetic oligonucleotide
uaaaagcaagugccacuaauucuaagu

SEQ ID NO: 7966 - RNA, 27 nt, Artificial Sequence
  Synthetic oligonucleotide
auaaaagcaagugccacuaauucuaag

SEQ ID NO: 7967 - RNA, 27 nt, Artificial Sequence
  Synthetic oligonucleotide
aauaaaagcaagugccacuaauucuaa

SEQ ID NO: 7968 - RNA, 27 nt, Artificial Sequence
  Synthetic oligonucleotide
uaauaaaagcaagugccacuaauucua

SEQ ID NO: 7969 - RNA, 27 nt, Artificial Sequence
  Synthetic oligonucleotide
cuaauaaaagcaagugccacuaauucu

SEQ ID NO: 7970 - RNA, 27 nt, Artificial Sequence
  Synthetic oligonucleotide
ucuaauaaaagcaagugccacuaauuc

SEQ ID NO: 7971 - RNA, 27 nt, Artificial Sequence
  Synthetic oligonucleotide
cucuaauaaaagcaagugccacuaauu

SEQ ID NO: 7972 - RNA, 27 nt, Artificial Sequence
  Synthetic oligonucleotide
ucucuaauaaaagcaagugccacuaau

SEQ ID NO: 7973 - RNA, 27 nt, Artificial Sequence
  Synthetic oligonucleotide
uucucuaauaaaagcaagugccacuaa

SEQ ID NO: 7974 - RNA, 27 nt, Artificial Sequence
  Synthetic oligonucleotide
auucucuaauaaaagcaagugccacua

SEQ ID NO: 7975 - RNA, 27 nt, Artificial Sequence
  Synthetic oligonucleotide
cauucucuaauaaaagcaagugccacu

SEQ ID NO: 7976 - RNA, 27 nt, Artificial Sequence
  Synthetic oligonucleotide
ucauucucuaauaaaagcaagugccac

SEQ ID NO: 7977 - RNA, 27 nt, Artificial Sequence
  Synthetic oligonucleotide
aucauucucuaauaaaagcaagugcca

SEQ ID NO: 7978 - RNA, 27 nt, Artificial Sequence
  Synthetic oligonucleotide
aaucauucucuaauaaaagcaagugcc

SEQ ID NO: 7979 - RNA, 27 nt, Artificial Sequence
  Synthetic oligonucleotide
aaaucauucucuaauaaaagcaagugc

SEQ ID NO: 7980 - RNA, 27 nt, Artificial Sequence
  Synthetic oligonucleotide
gaaaucauucucuaauaaaagcaagug

SEQ ID NO: 7981 - RNA, 27 nt, Artificial Sequence
  Synthetic oligonucleotide
cauuugaaaucauucucuaauaaaagc

SEQ ID NO: 7982 - RNA, 27 nt, Artificial Sequence
  Synthetic oligonucleotide
ccauguuauuucagaaaguuacagcau

SEQ ID NO: 7983 - RNA, 27 nt, Artificial Sequence
  Synthetic oligonucleotide
gccauguuauuucagaaaguuacagca

SEQ ID NO: 7984 - RNA, 27 nt, Artificial Sequence
  Synthetic oligonucleotide
ggccauguuauuucagaaaguuacagc

SEQ ID NO: 7985 - RNA, 27 nt, Artificial Sequence
  Synthetic oligonucleotide
aggccauguuauuucagaaaguuacag

SEQ ID NO: 7986 - RNA, 27 nt, Artificial Sequence
  Synthetic oligonucleotide
aaggccauguuauuucagaaaguuaca

SEQ ID NO: 7987 - RNA, 27 nt, Artificial Sequence
  Synthetic oligonucleotide
caaggccauguuauuucagaaaguuac

SEQ ID NO: 7988 - RNA, 27 nt, Artificial Sequence
  Synthetic oligonucleotide
ccaaggccauguuauuucagaaaguua

SEQ ID NO: 7989 - RNA, 27 nt, Artificial Sequence
  Synthetic oligonucleotide
uccaaggccauguuauuucagaaaguu

SEQ ID NO: 7990 - RNA, 27 nt, Artificial Sequence
  Synthetic oligonucleotide
cuccaaggccauguuauuucagaaagu

SEQ ID NO: 7991 - RNA, 27 nt, Artificial Sequence
  Synthetic oligonucleotide
ccuccaaggccauguuauuucagaaag

SEQ ID NO: 7992 - RNA, 27 nt, Artificial Sequence
  Synthetic oligonucleotide
cccuccaaggccauguuauuucagaaa

SEQ ID NO: 7993 - RNA, 27 nt, Artificial Sequence
  Synthetic oligonucleotide
gcccuccaaggccauguuauuucagaa

SEQ ID NO: 7994 - RNA, 27 nt, Artificial Sequence
  Synthetic oligonucleotide
ugcccuccaaggccauguuauuucaga

SEQ ID NO: 7995 - RNA, 27 nt, Artificial Sequence
  Synthetic oligonucleotide
augcccuccaaggccauguuauuucag

SEQ ID NO: 7996 - RNA, 27 nt, Artificial Sequence
  Synthetic oligonucleotide
caugcccuccaaggccauguuauuuca

SEQ ID NO: 7997 - RNA, 27 nt, Artificial Sequence
  Synthetic oligonucleotide
ucaugcccuccaaggccauguuauuuc

SEQ ID NO: 7998 - RNA, 27 nt, Artificial Sequence
  Synthetic oligonucleotide
uucaugcccuccaaggccauguuauuu

SEQ ID NO: 7999 - RNA, 27 nt, Artificial Sequence
  Synthetic oligonucleotide
cuucaugcccuccaaggccauguuauu

SEQ ID NO: 8000 - RNA, 27 nt, Artificial Sequence
  Synthetic oligonucleotide
ucuucaugcccuccaaggccauguuau

SEQ ID NO: 8001 - RNA, 27 nt, Artificial Sequence
  Synthetic oligonucleotide
gucuucaugcccuccaaggccauguua

SEQ ID NO: 8002 - RNA, 27 nt, Artificial Sequence
  Synthetic oligonucleotide
ugucuucaugcccuccaaggccauguu

SEQ ID NO: 8003 - RNA, 27 nt, Artificial Sequence
  Synthetic oligonucleotide
cugucuucaugcccuccaaggccaugu

SEQ ID NO: 8004 - RNA, 27 nt, Artificial Sequence
  Synthetic oligonucleotide
ucugucuucaugcccuccaaggccaug

SEQ ID NO: 8005 - RNA, 27 nt, Artificial Sequence
  Synthetic oligonucleotide
aucugucuucaugcccuccaaggccau

SEQ ID NO: 8006 - RNA, 27 nt, Artificial Sequence
  Synthetic oligonucleotide
uaucugucuucaugcccuccaaggcca

SEQ ID NO: 8007 - RNA, 27 nt, Artificial Sequence
  Synthetic oligonucleotide
guaucugucuucaugcccuccaaggcc

SEQ ID NO: 8008 - RNA, 27 nt, Artificial Sequence
  Synthetic oligonucleotide
aguaucugucuucaugcccuccaaggc

SEQ ID NO: 8009 - RNA, 27 nt, Artificial Sequence
  Synthetic oligonucleotide
gaguaucugucuucaugcccuccaagg

SEQ ID NO: 8010 - RNA, 27 nt, Artificial Sequence
  Synthetic oligonucleotide
ggaguaucugucuucaugcccuccaag

SEQ ID NO: 8011 - RNA, 27 nt, Artificial Sequence
  Synthetic oligonucleotide
aggaguaucugucuucaugcccuccaa

SEQ ID NO: 8012 - RNA, 27 nt, Artificial Sequence
  Synthetic oligonucleotide
gaggaguaucugucuucaugcccucca

SEQ ID NO: 8013 - RNA, 27 nt, Artificial Sequence
  Synthetic oligonucleotide
ggaggaguaucugucuucaugcccucc

SEQ ID NO: 8014 - RNA, 27 nt, Artificial Sequence
  Synthetic oligonucleotide
uggaggaguaucugucuucaugcccuc

SEQ ID NO: 8015 - RNA, 27 nt, Artificial Sequence
  Synthetic oligonucleotide
uuggaggaguaucugucuucaugcccu

SEQ ID NO: 8016 - RNA, 27 nt, Artificial Sequence
  Synthetic oligonucleotide
cuuggaggaguaucugucuucaugccc

SEQ ID NO: 8017 - RNA, 27 nt, Artificial Sequence
  Synthetic oligonucleotide
ccuuggaggaguaucugucuucaugcc

SEQ ID NO: 8018 - RNA, 27 nt, Artificial Sequence
  Synthetic oligonucleotide
accuuggaggaguaucugucuucaugc

SEQ ID NO: 8019 - RNA, 27 nt, Artificial Sequence
  Synthetic oligonucleotide
aaccuuggaggaguaucugucuucaug

SEQ ID NO: 8020 - RNA, 27 nt, Artificial Sequence
  Synthetic oligonucleotide
uaaccuuggaggaguaucugucuucau

SEQ ID NO: 8021 - RNA, 27 nt, Artificial Sequence
  Synthetic oligonucleotide
auaaccuuggaggaguaucugucuuca

SEQ ID NO: 8022 - RNA, 27 nt, Artificial Sequence
  Synthetic oligonucleotide
aauaaccuuggaggaguaucugucuuc

SEQ ID NO: 8023 - RNA, 27 nt, Artificial Sequence
  Synthetic oligonucleotide
caauaaccuuggaggaguaucugucuu

SEQ ID NO: 8024 - RNA, 27 nt, Artificial Sequence
  Synthetic oligonucleotide
ccaauaaccuuggaggaguaucugucu

SEQ ID NO: 8025 - RNA, 27 nt, Artificial Sequence
  Synthetic oligonucleotide
guccaauaaccuuggaggaguaucugu

SEQ ID NO: 8026 - RNA, 27 nt, Artificial Sequence
  Synthetic oligonucleotide
uguccaauaaccuuggaggaguaucug

SEQ ID NO: 8027 - RNA, 27 nt, Artificial Sequence
  Synthetic oligonucleotide
guguccaauaaccuuggaggaguaucu

SEQ ID NO: 8028 - RNA, 27 nt, Artificial Sequence
  Synthetic oligonucleotide
gguguccaauaaccuuggaggaguauc

SEQ ID NO: 8029 - RNA, 27 nt, Artificial Sequence
  Synthetic oligonucleotide
cgguguccaauaaccuuggaggaguau

SEQ ID NO: 8030 - RNA, 27 nt, Artificial Sequence
  Synthetic oligonucleotide
ccgguguccaauaaccuuggaggagua

SEQ ID NO: 8031 - RNA, 27 nt, Artificial Sequence
  Synthetic oligonucleotide
uccgguguccaauaaccuuggaggagu

SEQ ID NO: 8032 - RNA, 27 nt, Artificial Sequence
  Synthetic oligonucleotide
uuccgguguccaauaaccuuggaggag

SEQ ID NO: 8033 - RNA, 27 nt, Artificial Sequence
  Synthetic oligonucleotide
uuuccgguguccaauaaccuuggagga

SEQ ID NO: 8034 - RNA, 27 nt, Artificial Sequence
  Synthetic oligonucleotide
guuuccgguguccaauaaccuuggagg

SEQ ID NO: 8035 - RNA, 27 nt, Artificial Sequence
  Synthetic oligonucleotide
uguuuccgguguccaauaaccuuggag

SEQ ID NO: 8036 - RNA, 27 nt, Artificial Sequence
  Synthetic oligonucleotide
uuguuuccgguguccaauaaccuugga

SEQ ID NO: 8037 - RNA, 27 nt, Artificial Sequence
  Synthetic oligonucleotide
auuguuuccgguguccaauaaccuugg

SEQ ID NO: 8038 - RNA, 27 nt, Artificial Sequence
  Synthetic oligonucleotide
uauuguuuccgguguccaauaaccuug

SEQ ID NO: 8039 - RNA, 27 nt, Artificial Sequence
  Synthetic oligonucleotide
uuauuguuuccgguguccaauaaccuu

SEQ ID NO: 8040 - RNA, 27 nt, Artificial Sequence
  Synthetic oligonucleotide
uuuauuguuuccgguguccaauaaccu

SEQ ID NO: 8041 - RNA, 27 nt, Artificial Sequence
  Synthetic oligonucleotide
auuuauuguuuccgguguccaauaacc

SEQ ID NO: 8042 - RNA, 27 nt, Artificial Sequence
  Synthetic oligonucleotide
aauuuauuguuuccgguguccaauaac

SEQ ID NO: 8043 - RNA, 27 nt, Artificial Sequence
  Synthetic oligonucleotide
caauuuauuguuuccgguguccaauaa

SEQ ID NO: 8044 - RNA, 27 nt, Artificial Sequence
  Synthetic oligonucleotide
ccaauuuauuguuuccgguguccaaua

SEQ ID NO: 8045 - RNA, 27 nt, Artificial Sequence
  Synthetic oligonucleotide
uccaauuuauuguuuccgguguccaau

SEQ ID NO: 8046 - RNA, 27 nt, Artificial Sequence
  Synthetic oligonucleotide
uuccaauuuauuguuuccgguguccaa

SEQ ID NO: 8047 - RNA, 27 nt, Artificial Sequence
  Synthetic oligonucleotide
guuccaauuuauuguuuccggugucca

SEQ ID NO: 8048 - RNA, 27 nt, Artificial Sequence
  Synthetic oligonucleotide
uguuccaauuuauuguuuccggugucc

SEQ ID NO: 8049 - RNA, 27 nt, Artificial Sequence
  Synthetic oligonucleotide
gagugguagguuugaggagguguucca

SEQ ID NO: 8050 - RNA, 27 nt, Artificial Sequence
  Synthetic oligonucleotide
ugagugguagguuugaggagguguucc

SEQ ID NO: 8051 - RNA, 27 nt, Artificial Sequence
  Synthetic oligonucleotide
cugagugguagguuugaggagguguuc

SEQ ID NO: 8052 - RNA, 27 nt, Artificial Sequence
  Synthetic oligonucleotide
ccugagugguagguuugaggagguguu

SEQ ID NO: 8053 - RNA, 27 nt, Artificial Sequence
  Synthetic oligonucleotide
uccugagugguagguuugaggaggugu

SEQ ID NO: 8054 - RNA, 27 nt, Artificial Sequence
  Synthetic oligonucleotide
uuccugagugguagguuugaggaggug

SEQ ID NO: 8055 - RNA, 27 nt, Artificial Sequence
  Synthetic oligonucleotide
ccuuucaauggacuguucuuucggccc

SEQ ID NO: 8056 - RNA, 27 nt, Artificial Sequence
  Synthetic oligonucleotide
cccuuucaauggacuguucuuucggcc

SEQ ID NO: 8057 - RNA, 27 nt, Artificial Sequence
  Synthetic oligonucleotide
ucccuuucaauggacuguucuuucggc

SEQ ID NO: 8058 - RNA, 27 nt, Artificial Sequence
  Synthetic oligonucleotide
cucccuuucaauggacuguucuuucgg

SEQ ID NO: 8059 - RNA, 27 nt, Artificial Sequence
  Synthetic oligonucleotide
acucccuuucaauggacuguucuuucg

SEQ ID NO: 8060 - RNA, 27 nt, Artificial Sequence
  Synthetic oligonucleotide
aaaggccauguuuuuguaauacucccu

SEQ ID NO: 8061 - RNA, 27 nt, Artificial Sequence
  Synthetic oligonucleotide
caaaggccauguuuuuguaauacuccc

SEQ ID NO: 8062 - RNA, 27 nt, Artificial Sequence
  Synthetic oligonucleotide
gcaaaggccauguuuuuguaauacucc

SEQ ID NO: 8063 - RNA, 27 nt, Artificial Sequence
  Synthetic oligonucleotide
agcaaaggccauguuuuuguaauacuc

SEQ ID NO: 8064 - RNA, 27 nt, Artificial Sequence
  Synthetic oligonucleotide
aagcaaaggccauguuuuuguaauacu

SEQ ID NO: 8065 - RNA, 27 nt, Artificial Sequence
  Synthetic oligonucleotide
caagcaaaggccauguuuuuguaauac

SEQ ID NO: 8066 - RNA, 27 nt, Artificial Sequence
  Synthetic oligonucleotide
ucaagcaaaggccauguuuuuguaaua

SEQ ID NO: 8067 - RNA, 27 nt, Artificial Sequence
  Synthetic oligonucleotide
uucaagcaaaggccauguuuuuguaau

SEQ ID NO: 8068 - RNA, 27 nt, Artificial Sequence
  Synthetic oligonucleotide
uuucaagcaaaggccauguuuuuguaa

SEQ ID NO: 8069 - RNA, 27 nt, Artificial Sequence
  Synthetic oligonucleotide
cuuucaagcaaaggccauguuuuugua

SEQ ID NO: 8070 - RNA, 27 nt, Artificial Sequence
  Synthetic oligonucleotide
ucuuucaagcaaaggccauguuuuugu

SEQ ID NO: 8071 - RNA, 27 nt, Artificial Sequence
  Synthetic oligonucleotide
uucuuucaagcaaaggccauguuuuug

SEQ ID NO: 8072 - RNA, 27 nt, Artificial Sequence
  Synthetic oligonucleotide
uuucuuucaagcaaaggccauguuuuu

SEQ ID NO: 8073 - RNA, 27 nt, Artificial Sequence
  Synthetic oligonucleotide
uuuucuuucaagcaaaggccauguuuu

SEQ ID NO: 8074 - RNA, 27 nt, Artificial Sequence
  Synthetic oligonucleotide
auuuucuuucaagcaaaggccauguuu

SEQ ID NO: 8075 - RNA, 27 nt, Artificial Sequence
  Synthetic oligonucleotide
uauuuucuuucaagcaaaggccauguu

SEQ ID NO: 8076 - RNA, 27 nt, Artificial Sequence
  Synthetic oligonucleotide
guauuuucuuucaagcaaaggccaugu

SEQ ID NO: 8077 - RNA, 27 nt, Artificial Sequence
  Synthetic oligonucleotide
gguauuuucuuucaagcaaaggccaug

SEQ ID NO: 8078 - RNA, 27 nt, Artificial Sequence
  Synthetic oligonucleotide
ugguauuuucuuucaagcaaaggccau

SEQ ID NO: 8079 - RNA, 27 nt, Artificial Sequence
  Synthetic oligonucleotide
uugguauuuucuuucaagcaaaggcca

SEQ ID NO: 8080 - RNA, 27 nt, Artificial Sequence
  Synthetic oligonucleotide
cuugguauuuucuuucaagcaaaggcc

SEQ ID NO: 8081 - RNA, 27 nt, Artificial Sequence
  Synthetic oligonucleotide
ccuugguauuuucuuucaagcaaaggc

SEQ ID NO: 8082 - RNA, 27 nt, Artificial Sequence
  Synthetic oligonucleotide
uccuugguauuuucuuucaagcaaagg

SEQ ID NO: 8083 - RNA, 27 nt, Artificial Sequence
  Synthetic oligonucleotide
uuccuugguauuuucuuucaagcaaag

SEQ ID NO: 8084 - RNA, 27 nt, Artificial Sequence
  Synthetic oligonucleotide
guuccuugguauuuucuuucaagcaaa

SEQ ID NO: 8085 - RNA, 27 nt, Artificial Sequence
  Synthetic oligonucleotide
caggcuuuaaugaucaguuuccuguuc

SEQ ID NO: 8086 - RNA, 27 nt, Artificial Sequence
  Synthetic oligonucleotide
ucaggcuuuaaugaucaguuuccuguu

SEQ ID NO: 8087 - RNA, 27 nt, Artificial Sequence
  Synthetic oligonucleotide
cucaggcuuuaaugaucaguuuccugu

SEQ ID NO: 8088 - RNA, 27 nt, Artificial Sequence
  Synthetic oligonucleotide
acucaggcuuuaaugaucaguuuccug

SEQ ID NO: 8089 - RNA, 27 nt, Artificial Sequence
  Synthetic oligonucleotide
aacucaggcuuuaaugaucaguuuccu

SEQ ID NO: 8090 - RNA, 27 nt, Artificial Sequence
  Synthetic oligonucleotide
aaacucaggcuuuaaugaucaguuucc

SEQ ID NO: 8091 - RNA, 27 nt, Artificial Sequence
  Synthetic oligonucleotide
caaacucaggcuuuaaugaucaguuuc

SEQ ID NO: 8092 - RNA, 27 nt, Artificial Sequence
  Synthetic oligonucleotide
gcaaacucaggcuuuaaugaucaguuu

SEQ ID NO: 8093 - RNA, 27 nt, Artificial Sequence
  Synthetic oligonucleotide
agcaaacucaggcuuuaaugaucaguu

SEQ ID NO: 8094 - RNA, 27 nt, Artificial Sequence
  Synthetic oligonucleotide
aagcaaacucaggcuuuaaugaucagu

SEQ ID NO: 8095 - RNA, 27 nt, Artificial Sequence
  Synthetic oligonucleotide
aaagcaaacucaggcuuuaaugaucag

SEQ ID NO: 8096 - RNA, 27 nt, Artificial Sequence
  Synthetic oligonucleotide
gaaagcaaacucaggcuuuaaugauca

SEQ ID NO: 8097 - RNA, 27 nt, Artificial Sequence
  Synthetic oligonucleotide
ugaaagcaaacucaggcuuuaaugauc

SEQ ID NO: 8098 - RNA, 27 nt, Artificial Sequence
  Synthetic oligonucleotide
uuuugaaagcaaacucaggcuuuaaug

SEQ ID NO: 8099 - RNA, 27 nt, Artificial Sequence
  Synthetic oligonucleotide
uuuuugaaagcaaacucaggcuuuaau

SEQ ID NO: 8100 - DNA, 27 bp, Artificial Sequence
  Synthetic oligonucleotide
tcctgctacctccaaccatgggccttt

SEQ ID NO: 8101 - DNA, 27 bp, Artificial Sequence
  Synthetic oligonucleotide
cctgctacctccaaccatgggcctttt

SEQ ID NO: 8102 - DNA, 27 bp, Artificial Sequence
  Synthetic oligonucleotide
ctgctacctccaaccatgggccttttg

SEQ ID NO: 8103 - DNA, 27 bp, Artificial Sequence
  Synthetic oligonucleotide
tgctacctccaaccatgggccttttgg

SEQ ID NO: 8104 - DNA, 27 bp, Artificial Sequence
  Synthetic oligonucleotide
tacctccaaccatgggccttttgggaa

SEQ ID NO: 8105 - DNA, 27 bp, Artificial Sequence
  Synthetic oligonucleotide
acctccaaccatgggccttttgggaat

SEQ ID NO: 8106 - DNA, 27 bp, Artificial Sequence
  Synthetic oligonucleotide
cctccaaccatgggccttttgggaata

SEQ ID NO: 8107 - DNA, 27 bp, Artificial Sequence
  Synthetic oligonucleotide
ctccaaccatgggccttttgggaatac

SEQ ID NO: 8108 - DNA, 27 bp, Artificial Sequence
  Synthetic oligonucleotide
tccaaccatgggccttttgggaatact

SEQ ID NO: 8109 - DNA, 27 bp, Artificial Sequence
  Synthetic oligonucleotide
ccaaccatgggccttttgggaatactt

SEQ ID NO: 8110 - DNA, 27 bp, Artificial Sequence
  Synthetic oligonucleotide
caaccatgggccttttgggaatacttt

SEQ ID NO: 8111 - DNA, 27 bp, Artificial Sequence
  Synthetic oligonucleotide
aaccatgggccttttgggaatactttg

SEQ ID NO: 8112 - DNA, 27 bp, Artificial Sequence
  Synthetic oligonucleotide
accatgggccttttgggaatactttgt

SEQ ID NO: 8113 - DNA, 27 bp, Artificial Sequence
  Synthetic oligonucleotide
ccatgggccttttgggaatactttgtt

SEQ ID NO: 8114 - DNA, 27 bp, Artificial Sequence
  Synthetic oligonucleotide
catgggccttttgggaatactttgttt

SEQ ID NO: 8115 - DNA, 27 bp, Artificial Sequence
  Synthetic oligonucleotide
atgggccttttgggaatactttgtttt

SEQ ID NO: 8116 - DNA, 27 bp, Artificial Sequence
  Synthetic oligonucleotide
tgggccttttgggaatactttgttttt

SEQ ID NO: 8117 - DNA, 27 bp, Artificial Sequence
  Synthetic oligonucleotide
gggccttttgggaatactttgtttttt

SEQ ID NO: 8118 - DNA, 27 bp, Artificial Sequence
  Synthetic oligonucleotide
ggccttttgggaatactttgtttttta

SEQ ID NO: 8119 - DNA, 27 bp, Artificial Sequence
  Synthetic oligonucleotide
gccttttgggaatactttgttttttaa

SEQ ID NO: 8120 - DNA, 27 bp, Artificial Sequence
  Synthetic oligonucleotide
ccttttgggaatactttgttttttaat

SEQ ID NO: 8121 - DNA, 27 bp, Artificial Sequence
  Synthetic oligonucleotide
cttttgggaatactttgttttttaatc

SEQ ID NO: 8122 - DNA, 27 bp, Artificial Sequence
  Synthetic oligonucleotide
ttttgggaatactttgttttttaatct

SEQ ID NO: 8123 - DNA, 27 bp, Artificial Sequence
  Synthetic oligonucleotide
tttgggaatactttgttttttaatctt

SEQ ID NO: 8124 - DNA, 27 bp, Artificial Sequence
  Synthetic oligonucleotide
ttgggaatactttgttttttaatcttc

SEQ ID NO: 8125 - DNA, 27 bp, Artificial Sequence
  Synthetic oligonucleotide
tgggaatactttgttttttaatcttcc

SEQ ID NO: 8126 - DNA, 27 bp, Artificial Sequence
  Synthetic oligonucleotide
gggaatactttgttttttaatcttcct

SEQ ID NO: 8127 - DNA, 27 bp, Artificial Sequence
  Synthetic oligonucleotide
ggaatactttgttttttaatcttcctg

SEQ ID NO: 8128 - DNA, 27 bp, Artificial Sequence
  Synthetic oligonucleotide
gaatactttgttttttaatcttcctgg

SEQ ID NO: 8129 - DNA, 27 bp, Artificial Sequence
  Synthetic oligonucleotide
aatactttgttttttaatcttcctggg

SEQ ID NO: 8130 - DNA, 27 bp, Artificial Sequence
  Synthetic oligonucleotide
atactttgttttttaatcttcctgggg

SEQ ID NO: 8131 - DNA, 27 bp, Artificial Sequence
  Synthetic oligonucleotide
tactttgttttttaatcttcctgggga

SEQ ID NO: 8132 - DNA, 27 bp, Artificial Sequence
  Synthetic oligonucleotide
actttgttttttaatcttcctggggaa

SEQ ID NO: 8133 - DNA, 27 bp, Artificial Sequence
  Synthetic oligonucleotide
ctttgttttttaatcttcctggggaaa

SEQ ID NO: 8134 - DNA, 27 bp, Artificial Sequence
  Synthetic oligonucleotide
tttgttttttaatcttcctggggaaaa

SEQ ID NO: 8135 - DNA, 27 bp, Artificial Sequence
  Synthetic oligonucleotide
ttgttttttaatcttcctggggaaaac

SEQ ID NO: 8136 - DNA, 27 bp, Artificial Sequence
  Synthetic oligonucleotide
cctggggacaggagcaaacatatgtca

SEQ ID NO: 8137 - DNA, 27 bp, Artificial Sequence
  Synthetic oligonucleotide
ctggggacaggagcaaacatatgtcat

SEQ ID NO: 8138 - DNA, 27 bp, Artificial Sequence
  Synthetic oligonucleotide
tggggacaggagcaaacatatgtcatt

SEQ ID NO: 8139 - DNA, 27 bp, Artificial Sequence
  Synthetic oligonucleotide
ggggacaggagcaaacatatgtcattt

SEQ ID NO: 8140 - DNA, 27 bp, Artificial Sequence
  Synthetic oligonucleotide
gggacaggagcaaacatatgtcatttc

SEQ ID NO: 8141 - DNA, 27 bp, Artificial Sequence
  Synthetic oligonucleotide
ggacaggagcaaacatatgtcatttca

SEQ ID NO: 8142 - DNA, 27 bp, Artificial Sequence
  Synthetic oligonucleotide
gacaggagcaaacatatgtcatttcag

SEQ ID NO: 8143 - DNA, 27 bp, Artificial Sequence
  Synthetic oligonucleotide
acaggagcaaacatatgtcatttcagc

SEQ ID NO: 8144 - DNA, 27 bp, Artificial Sequence
  Synthetic oligonucleotide
caggagcaaacatatgtcatttcagca

SEQ ID NO: 8145 - DNA, 27 bp, Artificial Sequence
  Synthetic oligonucleotide
aggagcaaacatatgtcatttcagcac

SEQ ID NO: 8146 - DNA, 27 bp, Artificial Sequence
  Synthetic oligonucleotide
ggagcaaacatatgtcatttcagcacc

SEQ ID NO: 8147 - DNA, 27 bp, Artificial Sequence
  Synthetic oligonucleotide
gagcaaacatatgtcatttcagcacca

SEQ ID NO: 8148 - DNA, 27 bp, Artificial Sequence
  Synthetic oligonucleotide
agcaaacatatgtcatttcagcaccaa

SEQ ID NO: 8149 - DNA, 27 bp, Artificial Sequence
  Synthetic oligonucleotide
gcaaacatatgtcatttcagcaccaaa

SEQ ID NO: 8150 - DNA, 27 bp, Artificial Sequence
  Synthetic oligonucleotide
caaacatatgtcatttcagcaccaaaa

SEQ ID NO: 8151 - DNA, 27 bp, Artificial Sequence
  Synthetic oligonucleotide
aaacatatgtcatttcagcaccaaaaa

SEQ ID NO: 8152 - DNA, 27 bp, Artificial Sequence
  Synthetic oligonucleotide
aacatatgtcatttcagcaccaaaaat

SEQ ID NO: 8153 - DNA, 27 bp, Artificial Sequence
  Synthetic oligonucleotide
catatgtcatttcagcaccaaaaatat

SEQ ID NO: 8154 - DNA, 27 bp, Artificial Sequence
  Synthetic oligonucleotide
atatgtcatttcagcaccaaaaatatt

SEQ ID NO: 8155 - DNA, 27 bp, Artificial Sequence
  Synthetic oligonucleotide
tatgtcatttcagcaccaaaaatattc

SEQ ID NO: 8156 - DNA, 27 bp, Artificial Sequence
  Synthetic oligonucleotide
atgtcatttcagcaccaaaaatattcc

SEQ ID NO: 8157 - DNA, 27 bp, Artificial Sequence
  Synthetic oligonucleotide
tgtcatttcagcaccaaaaatattccg

SEQ ID NO: 8158 - DNA, 27 bp, Artificial Sequence
  Synthetic oligonucleotide
gtcatttcagcaccaaaaatattccgt

SEQ ID NO: 8159 - DNA, 27 bp, Artificial Sequence
  Synthetic oligonucleotide
tcatttcagcaccaaaaatattccgtg

SEQ ID NO: 8160 - DNA, 27 bp, Artificial Sequence
  Synthetic oligonucleotide
catttcagcaccaaaaatattccgtgt

SEQ ID NO: 8161 - DNA, 27 bp, Artificial Sequence
  Synthetic oligonucleotide
atttcagcaccaaaaatattccgtgtt

SEQ ID NO: 8162 - DNA, 27 bp, Artificial Sequence
  Synthetic oligonucleotide
tttcagcaccaaaaatattccgtgttg

SEQ ID NO: 8163 - DNA, 27 bp, Artificial Sequence
  Synthetic oligonucleotide
ttcagcaccaaaaatattccgtgttgg

SEQ ID NO: 8164 - DNA, 27 bp, Artificial Sequence
  Synthetic oligonucleotide
tcagcaccaaaaatattccgtgttgga

SEQ ID NO: 8165 - DNA, 27 bp, Artificial Sequence
  Synthetic oligonucleotide
cagcaccaaaaatattccgtgttggag

SEQ ID NO: 8166 - DNA, 27 bp, Artificial Sequence
  Synthetic oligonucleotide
agcaccaaaaatattccgtgttggagc

SEQ ID NO: 8167 - DNA, 27 bp, Artificial Sequence
  Synthetic oligonucleotide
gcaccaaaaatattccgtgttggagca

SEQ ID NO: 8168 - DNA, 27 bp, Artificial Sequence
  Synthetic oligonucleotide
caccaaaaatattccgtgttggagcat

SEQ ID NO: 8169 - DNA, 27 bp, Artificial Sequence
  Synthetic oligonucleotide
accaaaaatattccgtgttggagcatc

SEQ ID NO: 8170 - DNA, 27 bp, Artificial Sequence
  Synthetic oligonucleotide
ccaaaaatattccgtgttggagcatct

SEQ ID NO: 8171 - DNA, 27 bp, Artificial Sequence
  Synthetic oligonucleotide
caaaaatattccgtgttggagcatctg

SEQ ID NO: 8172 - DNA, 27 bp, Artificial Sequence
  Synthetic oligonucleotide
aaaaatattccgtgttggagcatctga

SEQ ID NO: 8173 - DNA, 27 bp, Artificial Sequence
  Synthetic oligonucleotide
aaaatattccgtgttggagcatctgaa

SEQ ID NO: 8174 - DNA, 27 bp, Artificial Sequence
  Synthetic oligonucleotide
aaatattccgtgttggagcatctgaaa

SEQ ID NO: 8175 - DNA, 27 bp, Artificial Sequence
  Synthetic oligonucleotide
aatattccgtgttggagcatctgaaaa

SEQ ID NO: 8176 - DNA, 27 bp, Artificial Sequence
  Synthetic oligonucleotide
atattccgtgttggagcatctgaaaat

SEQ ID NO: 8177 - DNA, 27 bp, Artificial Sequence
  Synthetic oligonucleotide
tattccgtgttggagcatctgaaaata

SEQ ID NO: 8178 - DNA, 27 bp, Artificial Sequence
  Synthetic oligonucleotide
attccgtgttggagcatctgaaaatat

SEQ ID NO: 8179 - DNA, 27 bp, Artificial Sequence
  Synthetic oligonucleotide
ttccgtgttggagcatctgaaaatatt

SEQ ID NO: 8180 - DNA, 27 bp, Artificial Sequence
  Synthetic oligonucleotide
tccgtgttggagcatctgaaaatattg

SEQ ID NO: 8181 - DNA, 27 bp, Artificial Sequence
  Synthetic oligonucleotide
ccgtgttggagcatctgaaaatattgt

SEQ ID NO: 8182 - DNA, 27 bp, Artificial Sequence
  Synthetic oligonucleotide
aagtttatggatacactgaagcatttg

SEQ ID NO: 8183 - DNA, 27 bp, Artificial Sequence
  Synthetic oligonucleotide
tttatggatacactgaagcatttgatg

SEQ ID NO: 8184 - DNA, 27 bp, Artificial Sequence
  Synthetic oligonucleotide
tatggatacactgaagcatttgatgca

SEQ ID NO: 8185 - DNA, 27 bp, Artificial Sequence
  Synthetic oligonucleotide
actgaagcatttgatgcaacaatctct

SEQ ID NO: 8186 - DNA, 27 bp, Artificial Sequence
  Synthetic oligonucleotide
tgaagcatttgatgcaacaatctctat

SEQ ID NO: 8187 - DNA, 27 bp, Artificial Sequence
  Synthetic oligonucleotide
aagcatttgatgcaacaatctctatta

SEQ ID NO: 8188 - DNA, 27 bp, Artificial Sequence
  Synthetic oligonucleotide
gcatttgatgcaacaatctctattaaa

SEQ ID NO: 8189 - DNA, 27 bp, Artificial Sequence
  Synthetic oligonucleotide
catttgatgcaacaatctctattaaaa

SEQ ID NO: 8190 - DNA, 27 bp, Artificial Sequence
  Synthetic oligonucleotide
atttgatgcaacaatctctattaaaag

SEQ ID NO: 8191 - DNA, 27 bp, Artificial Sequence
  Synthetic oligonucleotide
atgcaacaatctctattaaaagttatc

SEQ ID NO: 8192 - DNA, 27 bp, Artificial Sequence
  Synthetic oligonucleotide
tgcaacaatctctattaaaagttatcc

SEQ ID NO: 8193 - DNA, 27 bp, Artificial Sequence
  Synthetic oligonucleotide
gcaacaatctctattaaaagttatcct

SEQ ID NO: 8194 - DNA, 27 bp, Artificial Sequence
  Synthetic oligonucleotide
acaatctctattaaaagttatcctgat

SEQ ID NO: 8195 - DNA, 27 bp, Artificial Sequence
  Synthetic oligonucleotide
caatctctattaaaagttatcctgata

SEQ ID NO: 8196 - DNA, 27 bp, Artificial Sequence
  Synthetic oligonucleotide
aatctctattaaaagttatcctgataa

SEQ ID NO: 8197 - DNA, 27 bp, Artificial Sequence
  Synthetic oligonucleotide
atctctattaaaagttatcctgataaa

SEQ ID NO: 8198 - DNA, 27 bp, Artificial Sequence
  Synthetic oligonucleotide
tctctattaaaagttatcctgataaaa

SEQ ID NO: 8199 - DNA, 27 bp, Artificial Sequence
  Synthetic oligonucleotide
tctattaaaagttatcctgataaaaaa

SEQ ID NO: 8200 - DNA, 27 bp, Artificial Sequence
  Synthetic oligonucleotide
tattaaaagttatcctgataaaaaatt

SEQ ID NO: 8201 - DNA, 27 bp, Artificial Sequence
  Synthetic oligonucleotide
attaaaagttatcctgataaaaaattt

SEQ ID NO: 8202 - DNA, 27 bp, Artificial Sequence
  Synthetic oligonucleotide
aaaagttatcctgataaaaaatttagt

SEQ ID NO: 8203 - DNA, 27 bp, Artificial Sequence
  Synthetic oligonucleotide
aaagttatcctgataaaaaatttagtt

SEQ ID NO: 8204 - DNA, 27 bp, Artificial Sequence
  Synthetic oligonucleotide
gttatcctgataaaaaatttagttact

SEQ ID NO: 8205 - DNA, 27 bp, Artificial Sequence
  Synthetic oligonucleotide
ttatcctgataaaaaatttagttactc

SEQ ID NO: 8206 - DNA, 27 bp, Artificial Sequence
  Synthetic oligonucleotide
tatcctgataaaaaatttagttactcc

SEQ ID NO: 8207 - DNA, 27 bp, Artificial Sequence
  Synthetic oligonucleotide
atcctgataaaaaatttagttactcct

SEQ ID NO: 8208 - DNA, 27 bp, Artificial Sequence
  Synthetic oligonucleotide
tcctgataaaaaatttagttactcctc

SEQ ID NO: 8209 - DNA, 27 bp, Artificial Sequence
  Synthetic oligonucleotide
cctgataaaaaatttagttactcctca

SEQ ID NO: 8210 - DNA, 27 bp, Artificial Sequence
  Synthetic oligonucleotide
ctgataaaaaatttagttactcctcag

SEQ ID NO: 8211 - DNA, 27 bp, Artificial Sequence
  Synthetic oligonucleotide
tgataaaaaatttagttactcctcagg

SEQ ID NO: 8212 - DNA, 27 bp, Artificial Sequence
  Synthetic oligonucleotide
gataaaaaatttagttactcctcaggc

SEQ ID NO: 8213 - DNA, 27 bp, Artificial Sequence
  Synthetic oligonucleotide
ataaaaaatttagttactcctcaggcc

SEQ ID NO: 8214 - DNA, 27 bp, Artificial Sequence
  Synthetic oligonucleotide
taaaaaatttagttactcctcaggcca

SEQ ID NO: 8215 - DNA, 27 bp, Artificial Sequence
  Synthetic oligonucleotide
aaaaaatttagttactcctcaggccat

SEQ ID NO: 8216 - DNA, 27 bp, Artificial Sequence
  Synthetic oligonucleotide
aaaaatttagttactcctcaggccatg

SEQ ID NO: 8217 - DNA, 27 bp, Artificial Sequence
  Synthetic oligonucleotide
aaaatttagttactcctcaggccatgt

SEQ ID NO: 8218 - DNA, 27 bp, Artificial Sequence
  Synthetic oligonucleotide
aaatttagttactcctcaggccatgtt

SEQ ID NO: 8219 - DNA, 27 bp, Artificial Sequence
  Synthetic oligonucleotide
aatttagttactcctcaggccatgttc

SEQ ID NO: 8220 - DNA, 27 bp, Artificial Sequence
  Synthetic oligonucleotide
atttagttactcctcaggccatgttca

SEQ ID NO: 8221 - DNA, 27 bp, Artificial Sequence
  Synthetic oligonucleotide
tttagttactcctcaggccatgttcat

SEQ ID NO: 8222 - DNA, 27 bp, Artificial Sequence
  Synthetic oligonucleotide
ttagttactcctcaggccatgttcatt

SEQ ID NO: 8223 - DNA, 27 bp, Artificial Sequence
  Synthetic oligonucleotide
tagttactcctcaggccatgttcattt

SEQ ID NO: 8224 - DNA, 27 bp, Artificial Sequence
  Synthetic oligonucleotide
agttactcctcaggccatgttcattta

SEQ ID NO: 8225 - DNA, 27 bp, Artificial Sequence
  Synthetic oligonucleotide
gttactcctcaggccatgttcatttat

SEQ ID NO: 8226 - DNA, 27 bp, Artificial Sequence
  Synthetic oligonucleotide
ttactcctcaggccatgttcatttatc

SEQ ID NO: 8227 - DNA, 27 bp, Artificial Sequence
  Synthetic oligonucleotide
tactcctcaggccatgttcatttatcc

SEQ ID NO: 8228 - DNA, 27 bp, Artificial Sequence
  Synthetic oligonucleotide
actcctcaggccatgttcatttatcct

SEQ ID NO: 8229 - DNA, 27 bp, Artificial Sequence
  Synthetic oligonucleotide
ctcctcaggccatgttcatttatcctc

SEQ ID NO: 8230 - DNA, 27 bp, Artificial Sequence
  Synthetic oligonucleotide
tcctcaggccatgttcatttatcctca

SEQ ID NO: 8231 - DNA, 27 bp, Artificial Sequence
  Synthetic oligonucleotide
cctcaggccatgttcatttatcctcag

SEQ ID NO: 8232 - DNA, 27 bp, Artificial Sequence
  Synthetic oligonucleotide
ctcaggccatgttcatttatcctcaga

SEQ ID NO: 8233 - DNA, 27 bp, Artificial Sequence
  Synthetic oligonucleotide
tcaggccatgttcatttatcctcagag

SEQ ID NO: 8234 - DNA, 27 bp, Artificial Sequence
  Synthetic oligonucleotide
caggccatgttcatttatcctcagaga

SEQ ID NO: 8235 - DNA, 27 bp, Artificial Sequence
  Synthetic oligonucleotide
aggccatgttcatttatcctcagagaa

SEQ ID NO: 8236 - DNA, 27 bp, Artificial Sequence
  Synthetic oligonucleotide
ggccatgttcatttatcctcagagaat

SEQ ID NO: 8237 - DNA, 27 bp, Artificial Sequence
  Synthetic oligonucleotide
gccatgttcatttatcctcagagaata

SEQ ID NO: 8238 - DNA, 27 bp, Artificial Sequence
  Synthetic oligonucleotide
ccatgttcatttatcctcagagaataa

SEQ ID NO: 8239 - DNA, 27 bp, Artificial Sequence
  Synthetic oligonucleotide
catgttcatttatcctcagagaataaa

SEQ ID NO: 8240 - DNA, 27 bp, Artificial Sequence
  Synthetic oligonucleotide
gttcatttatcctcagagaataaattc

SEQ ID NO: 8241 - DNA, 27 bp, Artificial Sequence
  Synthetic oligonucleotide
ttcatttatcctcagagaataaattcc

SEQ ID NO: 8242 - DNA, 27 bp, Artificial Sequence
  Synthetic oligonucleotide
tcatttatcctcagagaataaattcca

SEQ ID NO: 8243 - DNA, 27 bp, Artificial Sequence
  Synthetic oligonucleotide
catttatcctcagagaataaattccaa

SEQ ID NO: 8244 - DNA, 27 bp, Artificial Sequence
  Synthetic oligonucleotide
atttatcctcagagaataaattccaaa

SEQ ID NO: 8245 - DNA, 27 bp, Artificial Sequence
  Synthetic oligonucleotide
tttatcctcagagaataaattccaaaa

SEQ ID NO: 8246 - DNA, 27 bp, Artificial Sequence
  Synthetic oligonucleotide
ttatcctcagagaataaattccaaaac

SEQ ID NO: 8247 - DNA, 27 bp, Artificial Sequence
  Synthetic oligonucleotide
tatcctcagagaataaattccaaaact

SEQ ID NO: 8248 - DNA, 27 bp, Artificial Sequence
  Synthetic oligonucleotide
atcctcagagaataaattccaaaactc

SEQ ID NO: 8249 - DNA, 27 bp, Artificial Sequence
  Synthetic oligonucleotide
tcctcagagaataaattccaaaactct

SEQ ID NO: 8250 - DNA, 27 bp, Artificial Sequence
  Synthetic oligonucleotide
cctcagagaataaattccaaaactctg

SEQ ID NO: 8251 - DNA, 27 bp, Artificial Sequence
  Synthetic oligonucleotide
ctcagagaataaattccaaaactctgc

SEQ ID NO: 8252 - DNA, 27 bp, Artificial Sequence
  Synthetic oligonucleotide
tcagagaataaattccaaaactctgca

SEQ ID NO: 8253 - DNA, 27 bp, Artificial Sequence
  Synthetic oligonucleotide
cagagaataaattccaaaactctgcaa

SEQ ID NO: 8254 - DNA, 27 bp, Artificial Sequence
  Synthetic oligonucleotide
agagaataaattccaaaactctgcaat

SEQ ID NO: 8255 - DNA, 27 bp, Artificial Sequence
  Synthetic oligonucleotide
aatcttaacaatacaaccaaaacaatt

SEQ ID NO: 8256 - DNA, 27 bp, Artificial Sequence
  Synthetic oligonucleotide
atcttaacaatacaaccaaaacaattg

SEQ ID NO: 8257 - DNA, 27 bp, Artificial Sequence
  Synthetic oligonucleotide
tcttaacaatacaaccaaaacaattgc

SEQ ID NO: 8258 - DNA, 27 bp, Artificial Sequence
  Synthetic oligonucleotide
cttaacaatacaaccaaaacaattgcc

SEQ ID NO: 8259 - DNA, 27 bp, Artificial Sequence
  Synthetic oligonucleotide
ttaacaatacaaccaaaacaattgcct

SEQ ID NO: 8260 - DNA, 27 bp, Artificial Sequence
  Synthetic oligonucleotide
taacaatacaaccaaaacaattgcctg

SEQ ID NO: 8261 - DNA, 27 bp, Artificial Sequence
  Synthetic oligonucleotide
aacaatacaaccaaaacaattgcctgg

SEQ ID NO: 8262 - DNA, 27 bp, Artificial Sequence
  Synthetic oligonucleotide
gtatttggaagttgtatcaaagcattt

SEQ ID NO: 8263 - DNA, 27 bp, Artificial Sequence
  Synthetic oligonucleotide
tatttggaagttgtatcaaagcatttt

SEQ ID NO: 8264 - DNA, 27 bp, Artificial Sequence
  Synthetic oligonucleotide
tgtatcaaagcatttttcaaaatcaaa

SEQ ID NO: 8265 - DNA, 27 bp, Artificial Sequence
  Synthetic oligonucleotide
gtatcaaagcatttttcaaaatcaaaa

SEQ ID NO: 8266 - DNA, 27 bp, Artificial Sequence
  Synthetic oligonucleotide
tatcaaagcatttttcaaaatcaaaaa

SEQ ID NO: 8267 - DNA, 27 bp, Artificial Sequence
  Synthetic oligonucleotide
atcaaagcatttttcaaaatcaaaaag

SEQ ID NO: 8268 - DNA, 27 bp, Artificial Sequence
  Synthetic oligonucleotide
tcaaagcatttttcaaaatcaaaaaga

SEQ ID NO: 8269 - DNA, 27 bp, Artificial Sequence
  Synthetic oligonucleotide
tgccaataacctatgacaatggatttc

SEQ ID NO: 8270 - DNA, 27 bp, Artificial Sequence
  Synthetic oligonucleotide
gccaataacctatgacaatggatttct

SEQ ID NO: 8271 - DNA, 27 bp, Artificial Sequence
  Synthetic oligonucleotide
caataacctatgacaatggatttctct

SEQ ID NO: 8272 - DNA, 27 bp, Artificial Sequence
  Synthetic oligonucleotide
aataacctatgacaatggatttctctt

SEQ ID NO: 8273 - DNA, 27 bp, Artificial Sequence
  Synthetic oligonucleotide
ataacctatgacaatggatttctcttc

SEQ ID NO: 8274 - DNA, 27 bp, Artificial Sequence
  Synthetic oligonucleotide
taacctatgacaatggatttctcttca

SEQ ID NO: 8275 - DNA, 27 bp, Artificial Sequence
  Synthetic oligonucleotide
aacctatgacaatggatttctcttcat

SEQ ID NO: 8276 - DNA, 27 bp, Artificial Sequence
  Synthetic oligonucleotide
cctatgacaatggatttctcttcattc

SEQ ID NO: 8277 - DNA, 27 bp, Artificial Sequence
  Synthetic oligonucleotide
ctatgacaatggatttctcttcattca

SEQ ID NO: 8278 - DNA, 27 bp, Artificial Sequence
  Synthetic oligonucleotide
tatgacaatggatttctcttcattcat

SEQ ID NO: 8279 - DNA, 27 bp, Artificial Sequence
  Synthetic oligonucleotide
acaatggatttctcttcattcatacag

SEQ ID NO: 8280 - DNA, 27 bp, Artificial Sequence
  Synthetic oligonucleotide
atggatttctcttcattcatacagaca

SEQ ID NO: 8281 - DNA, 27 bp, Artificial Sequence
  Synthetic oligonucleotide
ggatttctcttcattcatacagacaaa

SEQ ID NO: 8282 - DNA, 27 bp, Artificial Sequence
  Synthetic oligonucleotide
gatttctcttcattcatacagacaaac

SEQ ID NO: 8283 - DNA, 27 bp, Artificial Sequence
  Synthetic oligonucleotide
atttctcttcattcatacagacaaacc

SEQ ID NO: 8284 - DNA, 27 bp, Artificial Sequence
  Synthetic oligonucleotide
tttctcttcattcatacagacaaacct

SEQ ID NO: 8285 - DNA, 27 bp, Artificial Sequence
  Synthetic oligonucleotide
ttctcttcattcatacagacaaacctg

SEQ ID NO: 8286 - DNA, 27 bp, Artificial Sequence
  Synthetic oligonucleotide
tctcttcattcatacagacaaacctgt

SEQ ID NO: 8287 - DNA, 27 bp, Artificial Sequence
  Synthetic oligonucleotide
ctcttcattcatacagacaaacctgtt

SEQ ID NO: 8288 - DNA, 27 bp, Artificial Sequence
  Synthetic oligonucleotide
tcttcattcatacagacaaacctgttt

SEQ ID NO: 8289 - DNA, 27 bp, Artificial Sequence
  Synthetic oligonucleotide
cttcattcatacagacaaacctgttta

SEQ ID NO: 8290 - DNA, 27 bp, Artificial Sequence
  Synthetic oligonucleotide
ttcattcatacagacaaacctgtttat

SEQ ID NO: 8291 - DNA, 27 bp, Artificial Sequence
  Synthetic oligonucleotide
cattcatacagacaaacctgtttatac

SEQ ID NO: 8292 - DNA, 27 bp, Artificial Sequence
  Synthetic oligonucleotide
catacagacaaacctgtttatactcca

SEQ ID NO: 8293 - DNA, 27 bp, Artificial Sequence
  Synthetic oligonucleotide
atacagacaaacctgtttatactccag

SEQ ID NO: 8294 - DNA, 27 bp, Artificial Sequence
  Synthetic oligonucleotide
tacagacaaacctgtttatactccaga

SEQ ID NO: 8295 - DNA, 27 bp, Artificial Sequence
  Synthetic oligonucleotide
acagacaaacctgtttatactccagac

SEQ ID NO: 8296 - DNA, 27 bp, Artificial Sequence
  Synthetic oligonucleotide
cagacaaacctgtttatactccagacc

SEQ ID NO: 8297 - DNA, 27 bp, Artificial Sequence
  Synthetic oligonucleotide
agacaaacctgtttatactccagacca

SEQ ID NO: 8298 - DNA, 27 bp, Artificial Sequence
  Synthetic oligonucleotide
gacaaacctgtttatactccagaccag

SEQ ID NO: 8299 - DNA, 27 bp, Artificial Sequence
  Synthetic oligonucleotide
acaaacctgtttatactccagaccagt

SEQ ID NO: 8300 - DNA, 27 bp, Artificial Sequence
  Synthetic oligonucleotide
caaacctgtttatactccagaccagtc

SEQ ID NO: 8301 - DNA, 27 bp, Artificial Sequence
  Synthetic oligonucleotide
aaacctgtttatactccagaccagtca

SEQ ID NO: 8302 - DNA, 27 bp, Artificial Sequence
  Synthetic oligonucleotide
aacctgtttatactccagaccagtcag

SEQ ID NO: 8303 - DNA, 27 bp, Artificial Sequence
  Synthetic oligonucleotide
acctgtttatactccagaccagtcagt

SEQ ID NO: 8304 - DNA, 27 bp, Artificial Sequence
  Synthetic oligonucleotide
agttagagtttattcgttgaatgacga

SEQ ID NO: 8305 - DNA, 27 bp, Artificial Sequence
  Synthetic oligonucleotide
gttagagtttattcgttgaatgacgac

SEQ ID NO: 8306 - DNA, 27 bp, Artificial Sequence
  Synthetic oligonucleotide
ttagagtttattcgttgaatgacgact

SEQ ID NO: 8307 - DNA, 27 bp, Artificial Sequence
  Synthetic oligonucleotide
tagagtttattcgttgaatgacgactt

SEQ ID NO: 8308 - DNA, 27 bp, Artificial Sequence
  Synthetic oligonucleotide
acgacttgaagccagccaaaagagaaa

SEQ ID NO: 8309 - DNA, 27 bp, Artificial Sequence
  Synthetic oligonucleotide
cgacttgaagccagccaaaagagaaac

SEQ ID NO: 8310 - DNA, 27 bp, Artificial Sequence
  Synthetic oligonucleotide
gacttgaagccagccaaaagagaaact

SEQ ID NO: 8311 - DNA, 27 bp, Artificial Sequence
  Synthetic oligonucleotide
acttgaagccagccaaaagagaaactg

SEQ ID NO: 8312 - DNA, 27 bp, Artificial Sequence
  Synthetic oligonucleotide
cttgaagccagccaaaagagaaactgt

SEQ ID NO: 8313 - DNA, 27 bp, Artificial Sequence
  Synthetic oligonucleotide
ttgaagccagccaaaagagaaactgtc

SEQ ID NO: 8314 - DNA, 27 bp, Artificial Sequence
  Synthetic oligonucleotide
tgaagccagccaaaagagaaactgtct

SEQ ID NO: 8315 - DNA, 27 bp, Artificial Sequence
  Synthetic oligonucleotide
gaagccagccaaaagagaaactgtctt

SEQ ID NO: 8316 - DNA, 27 bp, Artificial Sequence
  Synthetic oligonucleotide
aagccagccaaaagagaaactgtctta

SEQ ID NO: 8317 - DNA, 27 bp, Artificial Sequence
  Synthetic oligonucleotide
agccagccaaaagagaaactgtcttaa

SEQ ID NO: 8318 - DNA, 27 bp, Artificial Sequence
  Synthetic oligonucleotide
gccagccaaaagagaaactgtcttaac

SEQ ID NO: 8319 - DNA, 27 bp, Artificial Sequence
  Synthetic oligonucleotide
ccagccaaaagagaaactgtcttaact

SEQ ID NO: 8320 - DNA, 27 bp, Artificial Sequence
  Synthetic oligonucleotide
cagccaaaagagaaactgtcttaactt

SEQ ID NO: 8321 - DNA, 27 bp, Artificial Sequence
  Synthetic oligonucleotide
agccaaaagagaaactgtcttaacttt

SEQ ID NO: 8322 - DNA, 27 bp, Artificial Sequence
  Synthetic oligonucleotide
gccaaaagagaaactgtcttaactttc

SEQ ID NO: 8323 - DNA, 27 bp, Artificial Sequence
  Synthetic oligonucleotide
ccaaaagagaaactgtcttaactttca

SEQ ID NO: 8324 - DNA, 27 bp, Artificial Sequence
  Synthetic oligonucleotide
caaaagagaaactgtcttaactttcat

SEQ ID NO: 8325 - DNA, 27 bp, Artificial Sequence
  Synthetic oligonucleotide
aaaagagaaactgtcttaactttcata

SEQ ID NO: 8326 - DNA, 27 bp, Artificial Sequence
  Synthetic oligonucleotide
aaagagaaactgtcttaactttcatag

SEQ ID NO: 8327 - DNA, 27 bp, Artificial Sequence
  Synthetic oligonucleotide
aagagaaactgtcttaactttcataga

SEQ ID NO: 8328 - DNA, 27 bp, Artificial Sequence
  Synthetic oligonucleotide
gagaaactgtcttaactttcatagatc

SEQ ID NO: 8329 - DNA, 27 bp, Artificial Sequence
  Synthetic oligonucleotide
agaaactgtcttaactttcatagatcc

SEQ ID NO: 8330 - DNA, 27 bp, Artificial Sequence
  Synthetic oligonucleotide
gaaactgtcttaactttcatagatcct

SEQ ID NO: 8331 - DNA, 27 bp, Artificial Sequence
  Synthetic oligonucleotide
actgtcttaactttcatagatcctgaa

SEQ ID NO: 8332 - DNA, 27 bp, Artificial Sequence
  Synthetic oligonucleotide
ctgtcttaactttcatagatcctgaag

SEQ ID NO: 8333 - DNA, 27 bp, Artificial Sequence
  Synthetic oligonucleotide
tgtcttaactttcatagatcctgaagg

SEQ ID NO: 8334 - DNA, 27 bp, Artificial Sequence
  Synthetic oligonucleotide
gtcttaactttcatagatcctgaagga

SEQ ID NO: 8335 - DNA, 27 bp, Artificial Sequence
  Synthetic oligonucleotide
tcttaactttcatagatcctgaaggat

SEQ ID NO: 8336 - DNA, 27 bp, Artificial Sequence
  Synthetic oligonucleotide
cttaactttcatagatcctgaaggatc

SEQ ID NO: 8337 - DNA, 27 bp, Artificial Sequence
  Synthetic oligonucleotide
ttaactttcatagatcctgaaggatca

SEQ ID NO: 8338 - DNA, 27 bp, Artificial Sequence
  Synthetic oligonucleotide
taactttcatagatcctgaaggatcag

SEQ ID NO: 8339 - DNA, 27 bp, Artificial Sequence
  Synthetic oligonucleotide
aactttcatagatcctgaaggatcaga

SEQ ID NO: 8340 - DNA, 27 bp, Artificial Sequence
  Synthetic oligonucleotide
actttcatagatcctgaaggatcagaa

SEQ ID NO: 8341 - DNA, 27 bp, Artificial Sequence
  Synthetic oligonucleotide
ctttcatagatcctgaaggatcagaag

SEQ ID NO: 8342 - DNA, 27 bp, Artificial Sequence
  Synthetic oligonucleotide
tttcatagatcctgaaggatcagaagt

SEQ ID NO: 8343 - DNA, 27 bp, Artificial Sequence
  Synthetic oligonucleotide
ttcatagatcctgaaggatcagaagtt

SEQ ID NO: 8344 - DNA, 27 bp, Artificial Sequence
  Synthetic oligonucleotide
tcatagatcctgaaggatcagaagttg

SEQ ID NO: 8345 - DNA, 27 bp, Artificial Sequence
  Synthetic oligonucleotide
catagatcctgaaggatcagaagttga

SEQ ID NO: 8346 - DNA, 27 bp, Artificial Sequence
  Synthetic oligonucleotide
atagatcctgaaggatcagaagttgac

SEQ ID NO: 8347 - DNA, 27 bp, Artificial Sequence
  Synthetic oligonucleotide
agttgacatggtagaagaaattgatca

SEQ ID NO: 8348 - DNA, 27 bp, Artificial Sequence
  Synthetic oligonucleotide
gttgacatggtagaagaaattgatcat

SEQ ID NO: 8349 - DNA, 27 bp, Artificial Sequence
  Synthetic oligonucleotide
gacatggtagaagaaattgatcatatt

SEQ ID NO: 8350 - DNA, 27 bp, Artificial Sequence
  Synthetic oligonucleotide
acatggtagaagaaattgatcatattg

SEQ ID NO: 8351 - DNA, 27 bp, Artificial Sequence
  Synthetic oligonucleotide
catggtagaagaaattgatcatattgg

SEQ ID NO: 8352 - DNA, 27 bp, Artificial Sequence
  Synthetic oligonucleotide
ggtagaagaaattgatcatattggaat

SEQ ID NO: 8353 - DNA, 27 bp, Artificial Sequence
  Synthetic oligonucleotide
gtagaagaaattgatcatattggaatt

SEQ ID NO: 8354 - DNA, 27 bp, Artificial Sequence
  Synthetic oligonucleotide
tagaagaaattgatcatattggaatta

SEQ ID NO: 8355 - DNA, 27 bp, Artificial Sequence
  Synthetic oligonucleotide
aagaaattgatcatattggaattatct

SEQ ID NO: 8356 - DNA, 27 bp, Artificial Sequence
  Synthetic oligonucleotide
agaaattgatcatattggaattatctc

SEQ ID NO: 8357 - DNA, 27 bp, Artificial Sequence
  Synthetic oligonucleotide
gaaattgatcatattggaattatctct

SEQ ID NO: 8358 - DNA, 27 bp, Artificial Sequence
  Synthetic oligonucleotide
aaattgatcatattggaattatctctt

SEQ ID NO: 8359 - DNA, 27 bp, Artificial Sequence
  Synthetic oligonucleotide
aattgatcatattggaattatctcttt

SEQ ID NO: 8360 - DNA, 27 bp, Artificial Sequence
  Synthetic oligonucleotide
attgatcatattggaattatctctttt

SEQ ID NO: 8361 - DNA, 27 bp, Artificial Sequence
  Synthetic oligonucleotide
ttgatcatattggaattatctcttttc

SEQ ID NO: 8362 - DNA, 27 bp, Artificial Sequence
  Synthetic oligonucleotide
tgatcatattggaattatctcttttcc

SEQ ID NO: 8363 - DNA, 27 bp, Artificial Sequence
  Synthetic oligonucleotide
gatcatattggaattatctcttttcct

SEQ ID NO: 8364 - DNA, 27 bp, Artificial Sequence
  Synthetic oligonucleotide
atcatattggaattatctcttttcctg

SEQ ID NO: 8365 - DNA, 27 bp, Artificial Sequence
  Synthetic oligonucleotide
tcatattggaattatctcttttcctga

SEQ ID NO: 8366 - DNA, 27 bp, Artificial Sequence
  Synthetic oligonucleotide
catattggaattatctcttttcctgac

SEQ ID NO: 8367 - DNA, 27 bp, Artificial Sequence
  Synthetic oligonucleotide
atattggaattatctcttttcctgact

SEQ ID NO: 8368 - DNA, 27 bp, Artificial Sequence
  Synthetic oligonucleotide
tattggaattatctcttttcctgactt

SEQ ID NO: 8369 - DNA, 27 bp, Artificial Sequence
  Synthetic oligonucleotide
attggaattatctcttttcctgacttc

SEQ ID NO: 8370 - DNA, 27 bp, Artificial Sequence
  Synthetic oligonucleotide
tttcctgacttcaagattccgtctaat

SEQ ID NO: 8371 - DNA, 27 bp, Artificial Sequence
  Synthetic oligonucleotide
ttcctgacttcaagattccgtctaatc

SEQ ID NO: 8372 - DNA, 27 bp, Artificial Sequence
  Synthetic oligonucleotide
tcctgacttcaagattccgtctaatcc

SEQ ID NO: 8373 - DNA, 27 bp, Artificial Sequence
  Synthetic oligonucleotide
cctgacttcaagattccgtctaatcct

SEQ ID NO: 8374 - DNA, 27 bp, Artificial Sequence
  Synthetic oligonucleotide
ctgacttcaagattccgtctaatccta

SEQ ID NO: 8375 - DNA, 27 bp, Artificial Sequence
  Synthetic oligonucleotide
tgacttcaagattccgtctaatcctag

SEQ ID NO: 8376 - DNA, 27 bp, Artificial Sequence
  Synthetic oligonucleotide
gacttcaagattccgtctaatcctaga

SEQ ID NO: 8377 - DNA, 27 bp, Artificial Sequence
  Synthetic oligonucleotide
acttcaagattccgtctaatcctagat

SEQ ID NO: 8378 - DNA, 27 bp, Artificial Sequence
  Synthetic oligonucleotide
cttcaagattccgtctaatcctagata

SEQ ID NO: 8379 - DNA, 27 bp, Artificial Sequence
  Synthetic oligonucleotide
ttcaagattccgtctaatcctagatat

SEQ ID NO: 8380 - DNA, 27 bp, Artificial Sequence
  Synthetic oligonucleotide
tcaagattccgtctaatcctagatatg

SEQ ID NO: 8381 - DNA, 27 bp, Artificial Sequence
  Synthetic oligonucleotide
caagattccgtctaatcctagatatgg

SEQ ID NO: 8382 - DNA, 27 bp, Artificial Sequence
  Synthetic oligonucleotide
aagattccgtctaatcctagatatggt

SEQ ID NO: 8383 - DNA, 27 bp, Artificial Sequence
  Synthetic oligonucleotide
agattccgtctaatcctagatatggta

SEQ ID NO: 8384 - DNA, 27 bp, Artificial Sequence
  Synthetic oligonucleotide
gattccgtctaatcctagatatggtat

SEQ ID NO: 8385 - DNA, 27 bp, Artificial Sequence
  Synthetic oligonucleotide
attccgtctaatcctagatatggtatg

SEQ ID NO: 8386 - DNA, 27 bp, Artificial Sequence
  Synthetic oligonucleotide
ttccgtctaatcctagatatggtatgt

SEQ ID NO: 8387 - DNA, 27 bp, Artificial Sequence
  Synthetic oligonucleotide
tccgtctaatcctagatatggtatgtg

SEQ ID NO: 8388 - DNA, 27 bp, Artificial Sequence
  Synthetic oligonucleotide
ccgtctaatcctagatatggtatgtgg

SEQ ID NO: 8389 - DNA, 27 bp, Artificial Sequence
  Synthetic oligonucleotide
cgtctaatcctagatatggtatgtgga

SEQ ID NO: 8390 - DNA, 27 bp, Artificial Sequence
  Synthetic oligonucleotide
gtctaatcctagatatggtatgtggac

SEQ ID NO: 8391 - DNA, 27 bp, Artificial Sequence
  Synthetic oligonucleotide
tctaatcctagatatggtatgtggacg

SEQ ID NO: 8392 - DNA, 27 bp, Artificial Sequence
  Synthetic oligonucleotide
ctaatcctagatatggtatgtggacga

SEQ ID NO: 8393 - DNA, 27 bp, Artificial Sequence
  Synthetic oligonucleotide
taatcctagatatggtatgtggacgat

SEQ ID NO: 8394 - DNA, 27 bp, Artificial Sequence
  Synthetic oligonucleotide
aatcctagatatggtatgtggacgatc

SEQ ID NO: 8395 - DNA, 27 bp, Artificial Sequence
  Synthetic oligonucleotide
atcctagatatggtatgtggacgatca

SEQ ID NO: 8396 - DNA, 27 bp, Artificial Sequence
  Synthetic oligonucleotide
caaggctaaatataaagaggacttttc

SEQ ID NO: 8397 - DNA, 27 bp, Artificial Sequence
  Synthetic oligonucleotide
aaggctaaatataaagaggacttttca

SEQ ID NO: 8398 - DNA, 27 bp, Artificial Sequence
  Synthetic oligonucleotide
aggctaaatataaagaggacttttcaa

SEQ ID NO: 8399 - DNA, 27 bp, Artificial Sequence
  Synthetic oligonucleotide
ggctaaatataaagaggacttttcaac

SEQ ID NO: 8400 - DNA, 27 bp, Artificial Sequence
  Synthetic oligonucleotide
gctaaatataaagaggacttttcaaca

SEQ ID NO: 8401 - DNA, 27 bp, Artificial Sequence
  Synthetic oligonucleotide
ctaaatataaagaggacttttcaacaa

SEQ ID NO: 8402 - DNA, 27 bp, Artificial Sequence
  Synthetic oligonucleotide
taaatataaagaggacttttcaacaac

SEQ ID NO: 8403 - DNA, 27 bp, Artificial Sequence
  Synthetic oligonucleotide
aaatataaagaggacttttcaacaact

SEQ ID NO: 8404 - DNA, 27 bp, Artificial Sequence
  Synthetic oligonucleotide
aatataaagaggacttttcaacaactg

SEQ ID NO: 8405 - DNA, 27 bp, Artificial Sequence
  Synthetic oligonucleotide
atataaagaggacttttcaacaactgg

SEQ ID NO: 8406 - DNA, 27 bp, Artificial Sequence
  Synthetic oligonucleotide
tataaagaggacttttcaacaactgga

SEQ ID NO: 8407 - DNA, 27 bp, Artificial Sequence
  Synthetic oligonucleotide
ataaagaggacttttcaacaactggaa

SEQ ID NO: 8408 - DNA, 27 bp, Artificial Sequence
  Synthetic oligonucleotide
taaagaggacttttcaacaactggaac

SEQ ID NO: 8409 - DNA, 27 bp, Artificial Sequence
  Synthetic oligonucleotide
aaagaggacttttcaacaactggaacc

SEQ ID NO: 8410 - DNA, 27 bp, Artificial Sequence
  Synthetic oligonucleotide
aagaggacttttcaacaactggaaccg

SEQ ID NO: 8411 - DNA, 27 bp, Artificial Sequence
  Synthetic oligonucleotide
agaggacttttcaacaactggaaccgc

SEQ ID NO: 8412 - DNA, 27 bp, Artificial Sequence
  Synthetic oligonucleotide
gaggacttttcaacaactggaaccgca

SEQ ID NO: 8413 - DNA, 27 bp, Artificial Sequence
  Synthetic oligonucleotide
aggacttttcaacaactggaaccgcat

SEQ ID NO: 8414 - DNA, 27 bp, Artificial Sequence
  Synthetic oligonucleotide
ggacttttcaacaactggaaccgcata

SEQ ID NO: 8415 - DNA, 27 bp, Artificial Sequence
  Synthetic oligonucleotide
tattttgaagttaaagaatatgtcttg

SEQ ID NO: 8416 - DNA, 27 bp, Artificial Sequence
  Synthetic oligonucleotide
attttgaagttaaagaatatgtcttgc

SEQ ID NO: 8417 - DNA, 27 bp, Artificial Sequence
  Synthetic oligonucleotide
ttttgaagttaaagaatatgtcttgcc

SEQ ID NO: 8418 - DNA, 27 bp, Artificial Sequence
  Synthetic oligonucleotide
tttgaagttaaagaatatgtcttgcca

SEQ ID NO: 8419 - DNA, 27 bp, Artificial Sequence
  Synthetic oligonucleotide
ttgaagttaaagaatatgtcttgccac

SEQ ID NO: 8420 - DNA, 27 bp, Artificial Sequence
  Synthetic oligonucleotide
tgaagttaaagaatatgtcttgccaca

SEQ ID NO: 8421 - DNA, 27 bp, Artificial Sequence
  Synthetic oligonucleotide
gaagttaaagaatatgtcttgccacat

SEQ ID NO: 8422 - DNA, 27 bp, Artificial Sequence
  Synthetic oligonucleotide
aagttaaagaatatgtcttgccacatt

SEQ ID NO: 8423 - DNA, 27 bp, Artificial Sequence
  Synthetic oligonucleotide
taaagaatatgtcttgccacatttttc

SEQ ID NO: 8424 - DNA, 27 bp, Artificial Sequence
  Synthetic oligonucleotide
aaagaatatgtcttgccacatttttct

SEQ ID NO: 8425 - DNA, 27 bp, Artificial Sequence
  Synthetic oligonucleotide
aagaatatgtcttgccacatttttctg

SEQ ID NO: 8426 - DNA, 27 bp, Artificial Sequence
  Synthetic oligonucleotide
agaatatgtcttgccacatttttctgt

SEQ ID NO: 8427 - DNA, 27 bp, Artificial Sequence
  Synthetic oligonucleotide
gaatatgtcttgccacatttttctgtc

SEQ ID NO: 8428 - DNA, 27 bp, Artificial Sequence
  Synthetic oligonucleotide
aatatgtcttgccacatttttctgtct

SEQ ID NO: 8429 - DNA, 27 bp, Artificial Sequence
  Synthetic oligonucleotide
atatgtcttgccacatttttctgtctc

SEQ ID NO: 8430 - DNA, 27 bp, Artificial Sequence
  Synthetic oligonucleotide
tatgtcttgccacatttttctgtctca

SEQ ID NO: 8431 - DNA, 27 bp, Artificial Sequence
  Synthetic oligonucleotide
atgtcttgccacatttttctgtctcaa

SEQ ID NO: 8432 - DNA, 27 bp, Artificial Sequence
  Synthetic oligonucleotide
tgtcttgccacatttttctgtctcaat

SEQ ID NO: 8433 - DNA, 27 bp, Artificial Sequence
  Synthetic oligonucleotide
gtcttgccacatttttctgtctcaatc

SEQ ID NO: 8434 - DNA, 27 bp, Artificial Sequence
  Synthetic oligonucleotide
tcttgccacatttttctgtctcaatcg

SEQ ID NO: 8435 - DNA, 27 bp, Artificial Sequence
  Synthetic oligonucleotide
cttgccacatttttctgtctcaatcga

SEQ ID NO: 8436 - DNA, 27 bp, Artificial Sequence
  Synthetic oligonucleotide
ttgccacatttttctgtctcaatcgag

SEQ ID NO: 8437 - DNA, 27 bp, Artificial Sequence
  Synthetic oligonucleotide
aagaactttaagaattttgaaattact

SEQ ID NO: 8438 - DNA, 27 bp, Artificial Sequence
  Synthetic oligonucleotide
agaactttaagaattttgaaattacta

SEQ ID NO: 8439 - DNA, 27 bp, Artificial Sequence
  Synthetic oligonucleotide
gaactttaagaattttgaaattactat

SEQ ID NO: 8440 - DNA, 27 bp, Artificial Sequence
  Synthetic oligonucleotide
actttaagaattttgaaattactataa

SEQ ID NO: 8441 - DNA, 27 bp, Artificial Sequence
  Synthetic oligonucleotide
ctttaagaattttgaaattactataaa

SEQ ID NO: 8442 - DNA, 27 bp, Artificial Sequence
  Synthetic oligonucleotide
tttaagaattttgaaattactataaaa

SEQ ID NO: 8443 - DNA, 27 bp, Artificial Sequence
  Synthetic oligonucleotide
ttaagaattttgaaattactataaaag

SEQ ID NO: 8444 - DNA, 27 bp, Artificial Sequence
  Synthetic oligonucleotide
taagaattttgaaattactataaaagc

SEQ ID NO: 8445 - DNA, 27 bp, Artificial Sequence
  Synthetic oligonucleotide
aattttgaaattactataaaagcaaga

SEQ ID NO: 8446 - DNA, 27 bp, Artificial Sequence
  Synthetic oligonucleotide
attttgaaattactataaaagcaagat

SEQ ID NO: 8447 - DNA, 27 bp, Artificial Sequence
  Synthetic oligonucleotide
tgaaattactataaaagcaagatattt

SEQ ID NO: 8448 - DNA, 27 bp, Artificial Sequence
  Synthetic oligonucleotide
gaaattactataaaagcaagatatttt

SEQ ID NO: 8449 - DNA, 27 bp, Artificial Sequence
  Synthetic oligonucleotide
aaattactataaaagcaagatattttt

SEQ ID NO: 8450 - DNA, 27 bp, Artificial Sequence
  Synthetic oligonucleotide
aattactataaaagcaagatattttta

SEQ ID NO: 8451 - DNA, 27 bp, Artificial Sequence
  Synthetic oligonucleotide
attactataaaagcaagatatttttat

SEQ ID NO: 8452 - DNA, 27 bp, Artificial Sequence
  Synthetic oligonucleotide
ttactataaaagcaagatatttttata

SEQ ID NO: 8453 - DNA, 27 bp, Artificial Sequence
  Synthetic oligonucleotide
tactataaaagcaagatatttttataa

SEQ ID NO: 8454 - DNA, 27 bp, Artificial Sequence
  Synthetic oligonucleotide
actataaaagcaagatatttttataat

SEQ ID NO: 8455 - DNA, 27 bp, Artificial Sequence
  Synthetic oligonucleotide
ctataaaagcaagatatttttataata

SEQ ID NO: 8456 - DNA, 27 bp, Artificial Sequence
  Synthetic oligonucleotide
tataaaagcaagatatttttataataa

SEQ ID NO: 8457 - DNA, 27 bp, Artificial Sequence
  Synthetic oligonucleotide
ataaaagcaagatatttttataataaa

SEQ ID NO: 8458 - DNA, 27 bp, Artificial Sequence
  Synthetic oligonucleotide
agatatttttataataaagtagtcact

SEQ ID NO: 8459 - DNA, 27 bp, Artificial Sequence
  Synthetic oligonucleotide
gatatttttataataaagtagtcactg

SEQ ID NO: 8460 - DNA, 27 bp, Artificial Sequence
  Synthetic oligonucleotide
atatttttataataaagtagtcactga

SEQ ID NO: 8461 - DNA, 27 bp, Artificial Sequence
  Synthetic oligonucleotide
tatttttataataaagtagtcactgag

SEQ ID NO: 8462 - DNA, 27 bp, Artificial Sequence
  Synthetic oligonucleotide
atttttataataaagtagtcactgagg

SEQ ID NO: 8463 - DNA, 27 bp, Artificial Sequence
  Synthetic oligonucleotide
tttttataataaagtagtcactgaggc

SEQ ID NO: 8464 - DNA, 27 bp, Artificial Sequence
  Synthetic oligonucleotide
ttttataataaagtagtcactgaggct

SEQ ID NO: 8465 - DNA, 27 bp, Artificial Sequence
  Synthetic oligonucleotide
tttataataaagtagtcactgaggctg

SEQ ID NO: 8466 - DNA, 27 bp, Artificial Sequence
  Synthetic oligonucleotide
ttataataaagtagtcactgaggctga

SEQ ID NO: 8467 - DNA, 27 bp, Artificial Sequence
  Synthetic oligonucleotide
tataataaagtagtcactgaggctgac

SEQ ID NO: 8468 - DNA, 27 bp, Artificial Sequence
  Synthetic oligonucleotide
ataataaagtagtcactgaggctgacg

SEQ ID NO: 8469 - DNA, 27 bp, Artificial Sequence
  Synthetic oligonucleotide
taataaagtagtcactgaggctgacgt

SEQ ID NO: 8470 - DNA, 27 bp, Artificial Sequence
  Synthetic oligonucleotide
aataaagtagtcactgaggctgacgtt

SEQ ID NO: 8471 - DNA, 27 bp, Artificial Sequence
  Synthetic oligonucleotide
ataaagtagtcactgaggctgacgttt

SEQ ID NO: 8472 - DNA, 27 bp, Artificial Sequence
  Synthetic oligonucleotide
taaagtagtcactgaggctgacgttta

SEQ ID NO: 8473 - DNA, 27 bp, Artificial Sequence
  Synthetic oligonucleotide
acgtttatatcacatttggaataagag

SEQ ID NO: 8474 - DNA, 27 bp, Artificial Sequence
  Synthetic oligonucleotide
cgtttatatcacatttggaataagaga

SEQ ID NO: 8475 - DNA, 27 bp, Artificial Sequence
  Synthetic oligonucleotide
gtttatatcacatttggaataagagaa

SEQ ID NO: 8476 - DNA, 27 bp, Artificial Sequence
  Synthetic oligonucleotide
tttatatcacatttggaataagagaag

SEQ ID NO: 8477 - DNA, 27 bp, Artificial Sequence
  Synthetic oligonucleotide
ttatatcacatttggaataagagaaga

SEQ ID NO: 8478 - DNA, 27 bp, Artificial Sequence
  Synthetic oligonucleotide
tatatcacatttggaataagagaagac

SEQ ID NO: 8479 - DNA, 27 bp, Artificial Sequence
  Synthetic oligonucleotide
atatcacatttggaataagagaagact

SEQ ID NO: 8480 - DNA, 27 bp, Artificial Sequence
  Synthetic oligonucleotide
tatcacatttggaataagagaagactt

SEQ ID NO: 8481 - DNA, 27 bp, Artificial Sequence
  Synthetic oligonucleotide
atcacatttggaataagagaagactta

SEQ ID NO: 8482 - DNA, 27 bp, Artificial Sequence
  Synthetic oligonucleotide
tcacatttggaataagagaagacttaa

SEQ ID NO: 8483 - DNA, 27 bp, Artificial Sequence
  Synthetic oligonucleotide
cacatttggaataagagaagacttaaa

SEQ ID NO: 8484 - DNA, 27 bp, Artificial Sequence
  Synthetic oligonucleotide
acatttggaataagagaagacttaaaa

SEQ ID NO: 8485 - DNA, 27 bp, Artificial Sequence
  Synthetic oligonucleotide
catttggaataagagaagacttaaaag

SEQ ID NO: 8486 - DNA, 27 bp, Artificial Sequence
  Synthetic oligonucleotide
atttggaataagagaagacttaaaaga

SEQ ID NO: 8487 - DNA, 27 bp, Artificial Sequence
  Synthetic oligonucleotide
tttggaataagagaagacttaaaagat

SEQ ID NO: 8488 - DNA, 27 bp, Artificial Sequence
  Synthetic oligonucleotide
ttggaataagagaagacttaaaagatg

SEQ ID NO: 8489 - DNA, 27 bp, Artificial Sequence
  Synthetic oligonucleotide
tggaataagagaagacttaaaagatga

SEQ ID NO: 8490 - DNA, 27 bp, Artificial Sequence
  Synthetic oligonucleotide
ggaataagagaagacttaaaagatgat

SEQ ID NO: 8491 - DNA, 27 bp, Artificial Sequence
  Synthetic oligonucleotide
gaataagagaagacttaaaagatgatc

SEQ ID NO: 8492 - DNA, 27 bp, Artificial Sequence
  Synthetic oligonucleotide
aataagagaagacttaaaagatgatca

SEQ ID NO: 8493 - DNA, 27 bp, Artificial Sequence
  Synthetic oligonucleotide
ataagagaagacttaaaagatgatcaa

SEQ ID NO: 8494 - DNA, 27 bp, Artificial Sequence
  Synthetic oligonucleotide
taagagaagacttaaaagatgatcaaa

SEQ ID NO: 8495 - DNA, 27 bp, Artificial Sequence
  Synthetic oligonucleotide
aagagaagacttaaaagatgatcaaaa

SEQ ID NO: 8496 - DNA, 27 bp, Artificial Sequence
  Synthetic oligonucleotide
agagaagacttaaaagatgatcaaaaa

SEQ ID NO: 8497 - DNA, 27 bp, Artificial Sequence
  Synthetic oligonucleotide
gagaagacttaaaagatgatcaaaaag

SEQ ID NO: 8498 - DNA, 27 bp, Artificial Sequence
  Synthetic oligonucleotide
agaagacttaaaagatgatcaaaaaga

SEQ ID NO: 8499 - DNA, 27 bp, Artificial Sequence
  Synthetic oligonucleotide
gaagacttaaaagatgatcaaaaagaa

SEQ ID NO: 8500 - DNA, 27 bp, Artificial Sequence
  Synthetic oligonucleotide
aagacttaaaagatgatcaaaaagaaa

SEQ ID NO: 8501 - DNA, 27 bp, Artificial Sequence
  Synthetic oligonucleotide
agacttaaaagatgatcaaaaagaaat

SEQ ID NO: 8502 - DNA, 27 bp, Artificial Sequence
  Synthetic oligonucleotide
gacttaaaagatgatcaaaaagaaatg

SEQ ID NO: 8503 - DNA, 27 bp, Artificial Sequence
  Synthetic oligonucleotide
acttaaaagatgatcaaaaagaaatga

SEQ ID NO: 8504 - DNA, 27 bp, Artificial Sequence
  Synthetic oligonucleotide
cttaaaagatgatcaaaaagaaatgat

SEQ ID NO: 8505 - DNA, 27 bp, Artificial Sequence
  Synthetic oligonucleotide
ttaaaagatgatcaaaaagaaatgatg

SEQ ID NO: 8506 - DNA, 27 bp, Artificial Sequence
  Synthetic oligonucleotide
taaaagatgatcaaaaagaaatgatgc

SEQ ID NO: 8507 - DNA, 27 bp, Artificial Sequence
  Synthetic oligonucleotide
aaaagatgatcaaaaagaaatgatgca

SEQ ID NO: 8508 - DNA, 27 bp, Artificial Sequence
  Synthetic oligonucleotide
aaagatgatcaaaaagaaatgatgcaa

SEQ ID NO: 8509 - DNA, 27 bp, Artificial Sequence
  Synthetic oligonucleotide
aagatgatcaaaaagaaatgatgcaaa

SEQ ID NO: 8510 - DNA, 27 bp, Artificial Sequence
  Synthetic oligonucleotide
agatgatcaaaaagaaatgatgcaaac

SEQ ID NO: 8511 - DNA, 27 bp, Artificial Sequence
  Synthetic oligonucleotide
gatgatcaaaaagaaatgatgcaaaca

SEQ ID NO: 8512 - DNA, 27 bp, Artificial Sequence
  Synthetic oligonucleotide
atgatcaaaaagaaatgatgcaaacag

SEQ ID NO: 8513 - DNA, 27 bp, Artificial Sequence
  Synthetic oligonucleotide
tgatcaaaaagaaatgatgcaaacagc

SEQ ID NO: 8514 - DNA, 27 bp, Artificial Sequence
  Synthetic oligonucleotide
gatcaaaaagaaatgatgcaaacagca

SEQ ID NO: 8515 - DNA, 27 bp, Artificial Sequence
  Synthetic oligonucleotide
atcaaaaagaaatgatgcaaacagcaa

SEQ ID NO: 8516 - DNA, 27 bp, Artificial Sequence
  Synthetic oligonucleotide
tcaaaaagaaatgatgcaaacagcaat

SEQ ID NO: 8517 - DNA, 27 bp, Artificial Sequence
  Synthetic oligonucleotide
caaaaagaaatgatgcaaacagcaatg

SEQ ID NO: 8518 - DNA, 27 bp, Artificial Sequence
  Synthetic oligonucleotide
aaaaagaaatgatgcaaacagcaatgc

SEQ ID NO: 8519 - DNA, 27 bp, Artificial Sequence
  Synthetic oligonucleotide
aaaagaaatgatgcaaacagcaatgca

SEQ ID NO: 8520 - DNA, 27 bp, Artificial Sequence
  Synthetic oligonucleotide
aaagaaatgatgcaaacagcaatgcaa

SEQ ID NO: 8521 - DNA, 27 bp, Artificial Sequence
  Synthetic oligonucleotide
aagaaatgatgcaaacagcaatgcaaa

SEQ ID NO: 8522 - DNA, 27 bp, Artificial Sequence
  Synthetic oligonucleotide
agaaatgatgcaaacagcaatgcaaaa

SEQ ID NO: 8523 - DNA, 27 bp, Artificial Sequence
  Synthetic oligonucleotide
gaaatgatgcaaacagcaatgcaaaac

SEQ ID NO: 8524 - DNA, 27 bp, Artificial Sequence
  Synthetic oligonucleotide
aaatgatgcaaacagcaatgcaaaaca

SEQ ID NO: 8525 - DNA, 27 bp, Artificial Sequence
  Synthetic oligonucleotide
aatgatgcaaacagcaatgcaaaacac

SEQ ID NO: 8526 - DNA, 27 bp, Artificial Sequence
  Synthetic oligonucleotide
caatgttgataaatggaattgctcaag

SEQ ID NO: 8527 - DNA, 27 bp, Artificial Sequence
  Synthetic oligonucleotide
gttgataaatggaattgctcaagtcac

SEQ ID NO: 8528 - DNA, 27 bp, Artificial Sequence
  Synthetic oligonucleotide
ttgataaatggaattgctcaagtcaca

SEQ ID NO: 8529 - DNA, 27 bp, Artificial Sequence
  Synthetic oligonucleotide
gataaatggaattgctcaagtcacatt

SEQ ID NO: 8530 - DNA, 27 bp, Artificial Sequence
  Synthetic oligonucleotide
ataaatggaattgctcaagtcacattt

SEQ ID NO: 8531 - DNA, 27 bp, Artificial Sequence
  Synthetic oligonucleotide
taaatggaattgctcaagtcacatttg

SEQ ID NO: 8532 - DNA, 27 bp, Artificial Sequence
  Synthetic oligonucleotide
aatggaattgctcaagtcacatttgat

SEQ ID NO: 8533 - DNA, 27 bp, Artificial Sequence
  Synthetic oligonucleotide
atggaattgctcaagtcacatttgatt

SEQ ID NO: 8534 - DNA, 27 bp, Artificial Sequence
  Synthetic oligonucleotide
tggaattgctcaagtcacatttgattc

SEQ ID NO: 8535 - DNA, 27 bp, Artificial Sequence
  Synthetic oligonucleotide
ggaattgctcaagtcacatttgattct

SEQ ID NO: 8536 - DNA, 27 bp, Artificial Sequence
  Synthetic oligonucleotide
gaattgctcaagtcacatttgattctg

SEQ ID NO: 8537 - DNA, 27 bp, Artificial Sequence
  Synthetic oligonucleotide
aattgctcaagtcacatttgattctga

SEQ ID NO: 8538 - DNA, 27 bp, Artificial Sequence
  Synthetic oligonucleotide
attgctcaagtcacatttgattctgaa

SEQ ID NO: 8539 - DNA, 27 bp, Artificial Sequence
  Synthetic oligonucleotide
ttgctcaagtcacatttgattctgaaa

SEQ ID NO: 8540 - DNA, 27 bp, Artificial Sequence
  Synthetic oligonucleotide
gctcaagtcacatttgattctgaaaca

SEQ ID NO: 8541 - DNA, 27 bp, Artificial Sequence
  Synthetic oligonucleotide
aagtcacatttgattctgaaacagcag

SEQ ID NO: 8542 - DNA, 27 bp, Artificial Sequence
  Synthetic oligonucleotide
agtcacatttgattctgaaacagcagt

SEQ ID NO: 8543 - DNA, 27 bp, Artificial Sequence
  Synthetic oligonucleotide
gtcacatttgattctgaaacagcagtc

SEQ ID NO: 8544 - DNA, 27 bp, Artificial Sequence
  Synthetic oligonucleotide
tcacatttgattctgaaacagcagtca

SEQ ID NO: 8545 - DNA, 27 bp, Artificial Sequence
  Synthetic oligonucleotide
acatttgattctgaaacagcagtcaaa

SEQ ID NO: 8546 - DNA, 27 bp, Artificial Sequence
  Synthetic oligonucleotide
tttgattctgaaacagcagtcaaagaa

SEQ ID NO: 8547 - DNA, 27 bp, Artificial Sequence
  Synthetic oligonucleotide
ttgattctgaaacagcagtcaaagaac

SEQ ID NO: 8548 - DNA, 27 bp, Artificial Sequence
  Synthetic oligonucleotide
tgattctgaaacagcagtcaaagaact

SEQ ID NO: 8549 - DNA, 27 bp, Artificial Sequence
  Synthetic oligonucleotide
gattctgaaacagcagtcaaagaactg

SEQ ID NO: 8550 - DNA, 27 bp, Artificial Sequence
  Synthetic oligonucleotide
attctgaaacagcagtcaaagaactgt

SEQ ID NO: 8551 - DNA, 27 bp, Artificial Sequence
  Synthetic oligonucleotide
ttctgaaacagcagtcaaagaactgtc

SEQ ID NO: 8552 - DNA, 27 bp, Artificial Sequence
  Synthetic oligonucleotide
tctgaaacagcagtcaaagaactgtca

SEQ ID NO: 8553 - DNA, 27 bp, Artificial Sequence
  Synthetic oligonucleotide
ctgaaacagcagtcaaagaactgtcat

SEQ ID NO: 8554 - DNA, 27 bp, Artificial Sequence
  Synthetic oligonucleotide
tgaaacagcagtcaaagaactgtcata

SEQ ID NO: 8555 - DNA, 27 bp, Artificial Sequence
  Synthetic oligonucleotide
gaaacagcagtcaaagaactgtcatac

SEQ ID NO: 8556 - DNA, 27 bp, Artificial Sequence
  Synthetic oligonucleotide
aaacagcagtcaaagaactgtcatact

SEQ ID NO: 8557 - DNA, 27 bp, Artificial Sequence
  Synthetic oligonucleotide
acagcagtcaaagaactgtcatactac

SEQ ID NO: 8558 - DNA, 27 bp, Artificial Sequence
  Synthetic oligonucleotide
agcagtcaaagaactgtcatactacag

SEQ ID NO: 8559 - DNA, 27 bp, Artificial Sequence
  Synthetic oligonucleotide
gcagtcaaagaactgtcatactacagt

SEQ ID NO: 8560 - DNA, 27 bp, Artificial Sequence
  Synthetic oligonucleotide
agtcaaagaactgtcatactacagttt

SEQ ID NO: 8561 - DNA, 27 bp, Artificial Sequence
  Synthetic oligonucleotide
gtcaaagaactgtcatactacagttta

SEQ ID NO: 8562 - DNA, 27 bp, Artificial Sequence
  Synthetic oligonucleotide
tcaaagaactgtcatactacagtttag

SEQ ID NO: 8563 - DNA, 27 bp, Artificial Sequence
  Synthetic oligonucleotide
aagaactgtcatactacagtttagaag

SEQ ID NO: 8564 - DNA, 27 bp, Artificial Sequence
  Synthetic oligonucleotide
gaactgtcatactacagtttagaagat

SEQ ID NO: 8565 - DNA, 27 bp, Artificial Sequence
  Synthetic oligonucleotide
aactgtcatactacagtttagaagatt

SEQ ID NO: 8566 - DNA, 27 bp, Artificial Sequence
  Synthetic oligonucleotide
actgtcatactacagtttagaagattt

SEQ ID NO: 8567 - DNA, 27 bp, Artificial Sequence
  Synthetic oligonucleotide
ctgtcatactacagtttagaagattta

SEQ ID NO: 8568 - DNA, 27 bp, Artificial Sequence
  Synthetic oligonucleotide
tgtcatactacagtttagaagatttaa

SEQ ID NO: 8569 - DNA, 27 bp, Artificial Sequence
  Synthetic oligonucleotide
gtcatactacagtttagaagatttaaa

SEQ ID NO: 8570 - DNA, 27 bp, Artificial Sequence
  Synthetic oligonucleotide
tcatactacagtttagaagatttaaac

SEQ ID NO: 8571 - DNA, 27 bp, Artificial Sequence
  Synthetic oligonucleotide
catactacagtttagaagatttaaaca

SEQ ID NO: 8572 - DNA, 27 bp, Artificial Sequence
  Synthetic oligonucleotide
atactacagtttagaagatttaaacaa

SEQ ID NO: 8573 - DNA, 27 bp, Artificial Sequence
  Synthetic oligonucleotide
tactacagtttagaagatttaaacaac

SEQ ID NO: 8574 - DNA, 27 bp, Artificial Sequence
  Synthetic oligonucleotide
actacagtttagaagatttaaacaaca

SEQ ID NO: 8575 - DNA, 27 bp, Artificial Sequence
  Synthetic oligonucleotide
ctacagtttagaagatttaaacaacaa

SEQ ID NO: 8576 - DNA, 27 bp, Artificial Sequence
  Synthetic oligonucleotide
tacagtttagaagatttaaacaacaag

SEQ ID NO: 8577 - DNA, 27 bp, Artificial Sequence
  Synthetic oligonucleotide
acagtttagaagatttaaacaacaagt

SEQ ID NO: 8578 - DNA, 27 bp, Artificial Sequence
  Synthetic oligonucleotide
cagtttagaagatttaaacaacaagta

SEQ ID NO: 8579 - DNA, 27 bp, Artificial Sequence
  Synthetic oligonucleotide
agtttagaagatttaaacaacaagtac

SEQ ID NO: 8580 - DNA, 27 bp, Artificial Sequence
  Synthetic oligonucleotide
gtttagaagatttaaacaacaagtacc

SEQ ID NO: 8581 - DNA, 27 bp, Artificial Sequence
  Synthetic oligonucleotide
tttagaagatttaaacaacaagtacct

SEQ ID NO: 8582 - DNA, 27 bp, Artificial Sequence
  Synthetic oligonucleotide
ttagaagatttaaacaacaagtacctt

SEQ ID NO: 8583 - DNA, 27 bp, Artificial Sequence
  Synthetic oligonucleotide
tagaagatttaaacaacaagtaccttt

SEQ ID NO: 8584 - DNA, 27 bp, Artificial Sequence
  Synthetic oligonucleotide
agaagatttaaacaacaagtaccttta

SEQ ID NO: 8585 - DNA, 27 bp, Artificial Sequence
  Synthetic oligonucleotide
gaagatttaaacaacaagtacctttat

SEQ ID NO: 8586 - DNA, 27 bp, Artificial Sequence
  Synthetic oligonucleotide
aagatttaaacaacaagtacctttata

SEQ ID NO: 8587 - DNA, 27 bp, Artificial Sequence
  Synthetic oligonucleotide
agatttaaacaacaagtacctttatat

SEQ ID NO: 8588 - DNA, 27 bp, Artificial Sequence
  Synthetic oligonucleotide
gatttaaacaacaagtacctttatatt

SEQ ID NO: 8589 - DNA, 27 bp, Artificial Sequence
  Synthetic oligonucleotide
agtacctttatattgctgtaacagtca

SEQ ID NO: 8590 - DNA, 27 bp, Artificial Sequence
  Synthetic oligonucleotide
tacctttatattgctgtaacagtcata

SEQ ID NO: 8591 - DNA, 27 bp, Artificial Sequence
  Synthetic oligonucleotide
acctttatattgctgtaacagtcatag

SEQ ID NO: 8592 - DNA, 27 bp, Artificial Sequence
  Synthetic oligonucleotide
cctttatattgctgtaacagtcataga

SEQ ID NO: 8593 - DNA, 27 bp, Artificial Sequence
  Synthetic oligonucleotide
ctttatattgctgtaacagtcatagag

SEQ ID NO: 8594 - DNA, 27 bp, Artificial Sequence
  Synthetic oligonucleotide
tttatattgctgtaacagtcatagagt

SEQ ID NO: 8595 - DNA, 27 bp, Artificial Sequence
  Synthetic oligonucleotide
ttatattgctgtaacagtcatagagtc

SEQ ID NO: 8596 - DNA, 27 bp, Artificial Sequence
  Synthetic oligonucleotide
tatattgctgtaacagtcatagagtct

SEQ ID NO: 8597 - DNA, 27 bp, Artificial Sequence
  Synthetic oligonucleotide
atattgctgtaacagtcatagagtcta

SEQ ID NO: 8598 - DNA, 27 bp, Artificial Sequence
  Synthetic oligonucleotide
tattgctgtaacagtcatagagtctac

SEQ ID NO: 8599 - DNA, 27 bp, Artificial Sequence
  Synthetic oligonucleotide
attgctgtaacagtcatagagtctaca

SEQ ID NO: 8600 - DNA, 27 bp, Artificial Sequence
  Synthetic oligonucleotide
ttgctgtaacagtcatagagtctacag

SEQ ID NO: 8601 - DNA, 27 bp, Artificial Sequence
  Synthetic oligonucleotide
tgctgtaacagtcatagagtctacagg

SEQ ID NO: 8602 - DNA, 27 bp, Artificial Sequence
  Synthetic oligonucleotide
gctgtaacagtcatagagtctacaggt

SEQ ID NO: 8603 - DNA, 27 bp, Artificial Sequence
  Synthetic oligonucleotide
ctgtaacagtcatagagtctacaggtg

SEQ ID NO: 8604 - DNA, 27 bp, Artificial Sequence
  Synthetic oligonucleotide
tgtaacagtcatagagtctacaggtgg

SEQ ID NO: 8605 - DNA, 27 bp, Artificial Sequence
  Synthetic oligonucleotide
gtaacagtcatagagtctacaggtgga

SEQ ID NO: 8606 - DNA, 27 bp, Artificial Sequence
  Synthetic oligonucleotide
taacagtcatagagtctacaggtggat

SEQ ID NO: 8607 - DNA, 27 bp, Artificial Sequence
  Synthetic oligonucleotide
aacagtcatagagtctacaggtggatt

SEQ ID NO: 8608 - DNA, 27 bp, Artificial Sequence
  Synthetic oligonucleotide
acagtcatagagtctacaggtggattt

SEQ ID NO: 8609 - DNA, 27 bp, Artificial Sequence
  Synthetic oligonucleotide
cagtcatagagtctacaggtggatttt

SEQ ID NO: 8610 - DNA, 27 bp, Artificial Sequence
  Synthetic oligonucleotide
agtcatagagtctacaggtggattttc

SEQ ID NO: 8611 - DNA, 27 bp, Artificial Sequence
  Synthetic oligonucleotide
gtcatagagtctacaggtggattttct

SEQ ID NO: 8612 - DNA, 27 bp, Artificial Sequence
  Synthetic oligonucleotide
tcatagagtctacaggtggattttctg

SEQ ID NO: 8613 - DNA, 27 bp, Artificial Sequence
  Synthetic oligonucleotide
catagagtctacaggtggattttctga

SEQ ID NO: 8614 - DNA, 27 bp, Artificial Sequence
  Synthetic oligonucleotide
atagagtctacaggtggattttctgaa

SEQ ID NO: 8615 - DNA, 27 bp, Artificial Sequence
  Synthetic oligonucleotide
tagagtctacaggtggattttctgaag

SEQ ID NO: 8616 - DNA, 27 bp, Artificial Sequence
  Synthetic oligonucleotide
agagtctacaggtggattttctgaaga

SEQ ID NO: 8617 - DNA, 27 bp, Artificial Sequence
  Synthetic oligonucleotide
gagtctacaggtggattttctgaagag

SEQ ID NO: 8618 - DNA, 27 bp, Artificial Sequence
  Synthetic oligonucleotide
agtctacaggtggattttctgaagagg

SEQ ID NO: 8619 - DNA, 27 bp, Artificial Sequence
  Synthetic oligonucleotide
gtctacaggtggattttctgaagaggc

SEQ ID NO: 8620 - DNA, 27 bp, Artificial Sequence
  Synthetic oligonucleotide
tctacaggtggattttctgaagaggca

SEQ ID NO: 8621 - DNA, 27 bp, Artificial Sequence
  Synthetic oligonucleotide
ctacaggtggattttctgaagaggcag

SEQ ID NO: 8622 - DNA, 27 bp, Artificial Sequence
  Synthetic oligonucleotide
tacaggtggattttctgaagaggcaga

SEQ ID NO: 8623 - DNA, 27 bp, Artificial Sequence
  Synthetic oligonucleotide
acaggtggattttctgaagaggcagaa

SEQ ID NO: 8624 - DNA, 27 bp, Artificial Sequence
  Synthetic oligonucleotide
caggtggattttctgaagaggcagaaa

SEQ ID NO: 8625 - DNA, 27 bp, Artificial Sequence
  Synthetic oligonucleotide
aggtggattttctgaagaggcagaaat

SEQ ID NO: 8626 - DNA, 27 bp, Artificial Sequence
  Synthetic oligonucleotide
ggtggattttctgaagaggcagaaata

SEQ ID NO: 8627 - DNA, 27 bp, Artificial Sequence
  Synthetic oligonucleotide
gtggattttctgaagaggcagaaatac

SEQ ID NO: 8628 - DNA, 27 bp, Artificial Sequence
  Synthetic oligonucleotide
tggattttctgaagaggcagaaatacc

SEQ ID NO: 8629 - DNA, 27 bp, Artificial Sequence
  Synthetic oligonucleotide
ggattttctgaagaggcagaaatacct

SEQ ID NO: 8630 - DNA, 27 bp, Artificial Sequence
  Synthetic oligonucleotide
gattttctgaagaggcagaaatacctg

SEQ ID NO: 8631 - DNA, 27 bp, Artificial Sequence
  Synthetic oligonucleotide
attttctgaagaggcagaaatacctgg

SEQ ID NO: 8632 - DNA, 27 bp, Artificial Sequence
  Synthetic oligonucleotide
ttttctgaagaggcagaaatacctggc

SEQ ID NO: 8633 - DNA, 27 bp, Artificial Sequence
  Synthetic oligonucleotide
tttctgaagaggcagaaatacctggca

SEQ ID NO: 8634 - DNA, 27 bp, Artificial Sequence
  Synthetic oligonucleotide
ttctgaagaggcagaaatacctggcat

SEQ ID NO: 8635 - DNA, 27 bp, Artificial Sequence
  Synthetic oligonucleotide
tctgaagaggcagaaatacctggcatc

SEQ ID NO: 8636 - DNA, 27 bp, Artificial Sequence
  Synthetic oligonucleotide
ctgaagaggcagaaatacctggcatca

SEQ ID NO: 8637 - DNA, 27 bp, Artificial Sequence
  Synthetic oligonucleotide
tgaagaggcagaaatacctggcatcaa

SEQ ID NO: 8638 - DNA, 27 bp, Artificial Sequence
  Synthetic oligonucleotide
gaagaggcagaaatacctggcatcaaa

SEQ ID NO: 8639 - DNA, 27 bp, Artificial Sequence
  Synthetic oligonucleotide
aagaggcagaaatacctggcatcaaat

SEQ ID NO: 8640 - DNA, 27 bp, Artificial Sequence
  Synthetic oligonucleotide
agaggcagaaatacctggcatcaaata

SEQ ID NO: 8641 - DNA, 27 bp, Artificial Sequence
  Synthetic oligonucleotide
gaggcagaaatacctggcatcaaatat

SEQ ID NO: 8642 - DNA, 27 bp, Artificial Sequence
  Synthetic oligonucleotide
aggcagaaatacctggcatcaaatatg

SEQ ID NO: 8643 - DNA, 27 bp, Artificial Sequence
  Synthetic oligonucleotide
ggcagaaatacctggcatcaaatatgt

SEQ ID NO: 8644 - DNA, 27 bp, Artificial Sequence
  Synthetic oligonucleotide
gcagaaatacctggcatcaaatatgtc

SEQ ID NO: 8645 - DNA, 27 bp, Artificial Sequence
  Synthetic oligonucleotide
cagaaatacctggcatcaaatatgtcc

SEQ ID NO: 8646 - DNA, 27 bp, Artificial Sequence
  Synthetic oligonucleotide
agaaatacctggcatcaaatatgtcct

SEQ ID NO: 8647 - DNA, 27 bp, Artificial Sequence
  Synthetic oligonucleotide
gaaatacctggcatcaaatatgtcctc

SEQ ID NO: 8648 - DNA, 27 bp, Artificial Sequence
  Synthetic oligonucleotide
aaatacctggcatcaaatatgtcctct

SEQ ID NO: 8649 - DNA, 27 bp, Artificial Sequence
  Synthetic oligonucleotide
aatacctggcatcaaatatgtcctctc

SEQ ID NO: 8650 - DNA, 27 bp, Artificial Sequence
  Synthetic oligonucleotide
atacctggcatcaaatatgtcctctct

SEQ ID NO: 8651 - DNA, 27 bp, Artificial Sequence
  Synthetic oligonucleotide
tacctggcatcaaatatgtcctctctc

SEQ ID NO: 8652 - DNA, 27 bp, Artificial Sequence
  Synthetic oligonucleotide
acctggcatcaaatatgtcctctctcc

SEQ ID NO: 8653 - DNA, 27 bp, Artificial Sequence
  Synthetic oligonucleotide
cctggcatcaaatatgtcctctctccc

SEQ ID NO: 8654 - DNA, 27 bp, Artificial Sequence
  Synthetic oligonucleotide
ctggcatcaaatatgtcctctctccct

SEQ ID NO: 8655 - DNA, 27 bp, Artificial Sequence
  Synthetic oligonucleotide
tggcatcaaatatgtcctctctcccta

SEQ ID NO: 8656 - DNA, 27 bp, Artificial Sequence
  Synthetic oligonucleotide
ggcatcaaatatgtcctctctccctac

SEQ ID NO: 8657 - DNA, 27 bp, Artificial Sequence
  Synthetic oligonucleotide
gcatcaaatatgtcctctctccctaca

SEQ ID NO: 8658 - DNA, 27 bp, Artificial Sequence
  Synthetic oligonucleotide
atcaaatatgtcctctctccctacaaa

SEQ ID NO: 8659 - DNA, 27 bp, Artificial Sequence
  Synthetic oligonucleotide
tcaaatatgtcctctctccctacaaac

SEQ ID NO: 8660 - DNA, 27 bp, Artificial Sequence
  Synthetic oligonucleotide
caaatatgtcctctctccctacaaact

SEQ ID NO: 8661 - DNA, 27 bp, Artificial Sequence
  Synthetic oligonucleotide
aaatatgtcctctctccctacaaactg

SEQ ID NO: 8662 - DNA, 27 bp, Artificial Sequence
  Synthetic oligonucleotide
aatatgtcctctctccctacaaactga

SEQ ID NO: 8663 - DNA, 27 bp, Artificial Sequence
  Synthetic oligonucleotide
atatgtcctctctccctacaaactgaa

SEQ ID NO: 8664 - DNA, 27 bp, Artificial Sequence
  Synthetic oligonucleotide
tatgtcctctctccctacaaactgaat

SEQ ID NO: 8665 - DNA, 27 bp, Artificial Sequence
  Synthetic oligonucleotide
atgtcctctctccctacaaactgaatt

SEQ ID NO: 8666 - DNA, 27 bp, Artificial Sequence
  Synthetic oligonucleotide
tgtcctctctccctacaaactgaattt

SEQ ID NO: 8667 - DNA, 27 bp, Artificial Sequence
  Synthetic oligonucleotide
gtcctctctccctacaaactgaatttg

SEQ ID NO: 8668 - DNA, 27 bp, Artificial Sequence
  Synthetic oligonucleotide
tcctctctccctacaaactgaatttgg

SEQ ID NO: 8669 - DNA, 27 bp, Artificial Sequence
  Synthetic oligonucleotide
cctctctccctacaaactgaatttggt

SEQ ID NO: 8670 - DNA, 27 bp, Artificial Sequence
  Synthetic oligonucleotide
ctctctccctacaaactgaatttggtt

SEQ ID NO: 8671 - DNA, 27 bp, Artificial Sequence
  Synthetic oligonucleotide
tctctccctacaaactgaatttggttg

SEQ ID NO: 8672 - DNA, 27 bp, Artificial Sequence
  Synthetic oligonucleotide
ctctccctacaaactgaatttggttgc

SEQ ID NO: 8673 - DNA, 27 bp, Artificial Sequence
  Synthetic oligonucleotide
tctccctacaaactgaatttggttgct

SEQ ID NO: 8674 - DNA, 27 bp, Artificial Sequence
  Synthetic oligonucleotide
tccctacaaactgaatttggttgctac

SEQ ID NO: 8675 - DNA, 27 bp, Artificial Sequence
  Synthetic oligonucleotide
ccctacaaactgaatttggttgctact

SEQ ID NO: 8676 - DNA, 27 bp, Artificial Sequence
  Synthetic oligonucleotide
cctacaaactgaatttggttgctactc

SEQ ID NO: 8677 - DNA, 27 bp, Artificial Sequence
  Synthetic oligonucleotide
acaaactgaatttggttgctactcctc

SEQ ID NO: 8678 - DNA, 27 bp, Artificial Sequence
  Synthetic oligonucleotide
caaactgaatttggttgctactcctct

SEQ ID NO: 8679 - DNA, 27 bp, Artificial Sequence
  Synthetic oligonucleotide
aaactgaatttggttgctactcctctt

SEQ ID NO: 8680 - DNA, 27 bp, Artificial Sequence
  Synthetic oligonucleotide
aactgaatttggttgctactcctcttt

SEQ ID NO: 8681 - DNA, 27 bp, Artificial Sequence
  Synthetic oligonucleotide
actgaatttggttgctactcctctttt

SEQ ID NO: 8682 - DNA, 27 bp, Artificial Sequence
  Synthetic oligonucleotide
ctgaatttggttgctactcctcttttc

SEQ ID NO: 8683 - DNA, 27 bp, Artificial Sequence
  Synthetic oligonucleotide
tgaatttggttgctactcctcttttcc

SEQ ID NO: 8684 - DNA, 27 bp, Artificial Sequence
  Synthetic oligonucleotide
gaatttggttgctactcctcttttcct

SEQ ID NO: 8685 - DNA, 27 bp, Artificial Sequence
  Synthetic oligonucleotide
aatttggttgctactcctcttttcctg

SEQ ID NO: 8686 - DNA, 27 bp, Artificial Sequence
  Synthetic oligonucleotide
atttggttgctactcctcttttcctga

SEQ ID NO: 8687 - DNA, 27 bp, Artificial Sequence
  Synthetic oligonucleotide
tttggttgctactcctcttttcctgaa

SEQ ID NO: 8688 - DNA, 27 bp, Artificial Sequence
  Synthetic oligonucleotide
ttggttgctactcctcttttcctgaag

SEQ ID NO: 8689 - DNA, 27 bp, Artificial Sequence
  Synthetic oligonucleotide
tggttgctactcctcttttcctgaagc

SEQ ID NO: 8690 - DNA, 27 bp, Artificial Sequence
  Synthetic oligonucleotide
ggttgctactcctcttttcctgaagcc

SEQ ID NO: 8691 - DNA, 27 bp, Artificial Sequence
  Synthetic oligonucleotide
gttgctactcctcttttcctgaagcct

SEQ ID NO: 8692 - DNA, 27 bp, Artificial Sequence
  Synthetic oligonucleotide
ttgctactcctcttttcctgaagcctg

SEQ ID NO: 8693 - DNA, 27 bp, Artificial Sequence
  Synthetic oligonucleotide
tgctactcctcttttcctgaagcctgg

SEQ ID NO: 8694 - DNA, 27 bp, Artificial Sequence
  Synthetic oligonucleotide
gctactcctcttttcctgaagcctggg

SEQ ID NO: 8695 - DNA, 27 bp, Artificial Sequence
  Synthetic oligonucleotide
ctactcctcttttcctgaagcctggga

SEQ ID NO: 8696 - DNA, 27 bp, Artificial Sequence
  Synthetic oligonucleotide
tactcctcttttcctgaagcctgggat

SEQ ID NO: 8697 - DNA, 27 bp, Artificial Sequence
  Synthetic oligonucleotide
actcctcttttcctgaagcctgggatt

SEQ ID NO: 8698 - DNA, 27 bp, Artificial Sequence
  Synthetic oligonucleotide
ctcctcttttcctgaagcctgggattc

SEQ ID NO: 8699 - DNA, 27 bp, Artificial Sequence
  Synthetic oligonucleotide
tcctcttttcctgaagcctgggattcc

SEQ ID NO: 8700 - DNA, 27 bp, Artificial Sequence
  Synthetic oligonucleotide
cctcttttcctgaagcctgggattcca

SEQ ID NO: 8701 - DNA, 27 bp, Artificial Sequence
  Synthetic oligonucleotide
ctcttttcctgaagcctgggattccat

SEQ ID NO: 8702 - DNA, 27 bp, Artificial Sequence
  Synthetic oligonucleotide
tcttttcctgaagcctgggattccata

SEQ ID NO: 8703 - DNA, 27 bp, Artificial Sequence
  Synthetic oligonucleotide
cttttcctgaagcctgggattccatat

SEQ ID NO: 8704 - DNA, 27 bp, Artificial Sequence
  Synthetic oligonucleotide
ttttcctgaagcctgggattccatatc

SEQ ID NO: 8705 - DNA, 27 bp, Artificial Sequence
  Synthetic oligonucleotide
tttcctgaagcctgggattccatatcc

SEQ ID NO: 8706 - DNA, 27 bp, Artificial Sequence
  Synthetic oligonucleotide
ttcctgaagcctgggattccatatccc

SEQ ID NO: 8707 - DNA, 27 bp, Artificial Sequence
  Synthetic oligonucleotide
tcctgaagcctgggattccatatccca

SEQ ID NO: 8708 - DNA, 27 bp, Artificial Sequence
  Synthetic oligonucleotide
cctgaagcctgggattccatatcccat

SEQ ID NO: 8709 - DNA, 27 bp, Artificial Sequence
  Synthetic oligonucleotide
ctgaagcctgggattccatatcccatc

SEQ ID NO: 8710 - DNA, 27 bp, Artificial Sequence
  Synthetic oligonucleotide
tcccatcaaggtgcaggttaaagattc

SEQ ID NO: 8711 - DNA, 27 bp, Artificial Sequence
  Synthetic oligonucleotide
cccatcaaggtgcaggttaaagattcg

SEQ ID NO: 8712 - DNA, 27 bp, Artificial Sequence
  Synthetic oligonucleotide
ccatcaaggtgcaggttaaagattcgc

SEQ ID NO: 8713 - DNA, 27 bp, Artificial Sequence
  Synthetic oligonucleotide
catcaaggtgcaggttaaagattcgct

SEQ ID NO: 8714 - DNA, 27 bp, Artificial Sequence
  Synthetic oligonucleotide
atcaaggtgcaggttaaagattcgctt

SEQ ID NO: 8715 - DNA, 27 bp, Artificial Sequence
  Synthetic oligonucleotide
ttcgcttgaccagttggtaggaggagt

SEQ ID NO: 8716 - DNA, 27 bp, Artificial Sequence
  Synthetic oligonucleotide
tcgcttgaccagttggtaggaggagtc

SEQ ID NO: 8717 - DNA, 27 bp, Artificial Sequence
  Synthetic oligonucleotide
cgcttgaccagttggtaggaggagtcc

SEQ ID NO: 8718 - DNA, 27 bp, Artificial Sequence
  Synthetic oligonucleotide
gcttgaccagttggtaggaggagtccc

SEQ ID NO: 8719 - DNA, 27 bp, Artificial Sequence
  Synthetic oligonucleotide
gagtcccagtaacactgaatgcacaaa

SEQ ID NO: 8720 - DNA, 27 bp, Artificial Sequence
  Synthetic oligonucleotide
agtcccagtaacactgaatgcacaaac

SEQ ID NO: 8721 - DNA, 27 bp, Artificial Sequence
  Synthetic oligonucleotide
gtcccagtaacactgaatgcacaaaca

SEQ ID NO: 8722 - DNA, 27 bp, Artificial Sequence
  Synthetic oligonucleotide
tcccagtaacactgaatgcacaaacaa

SEQ ID NO: 8723 - DNA, 27 bp, Artificial Sequence
  Synthetic oligonucleotide
cccagtaacactgaatgcacaaacaat

SEQ ID NO: 8724 - DNA, 27 bp, Artificial Sequence
  Synthetic oligonucleotide
ccagtaacactgaatgcacaaacaatt

SEQ ID NO: 8725 - DNA, 27 bp, Artificial Sequence
  Synthetic oligonucleotide
cagtaacactgaatgcacaaacaattg

SEQ ID NO: 8726 - DNA, 27 bp, Artificial Sequence
  Synthetic oligonucleotide
agtaacactgaatgcacaaacaattga

SEQ ID NO: 8727 - DNA, 27 bp, Artificial Sequence
  Synthetic oligonucleotide
gtaacactgaatgcacaaacaattgat

SEQ ID NO: 8728 - DNA, 27 bp, Artificial Sequence
  Synthetic oligonucleotide
taacactgaatgcacaaacaattgatg

SEQ ID NO: 8729 - DNA, 27 bp, Artificial Sequence
  Synthetic oligonucleotide
aacactgaatgcacaaacaattgatgt

SEQ ID NO: 8730 - DNA, 27 bp, Artificial Sequence
  Synthetic oligonucleotide
acactgaatgcacaaacaattgatgta

SEQ ID NO: 8731 - DNA, 27 bp, Artificial Sequence
  Synthetic oligonucleotide
ctgaatgcacaaacaattgatgtaaac

SEQ ID NO: 8732 - DNA, 27 bp, Artificial Sequence
  Synthetic oligonucleotide
tgaatgcacaaacaattgatgtaaacc

SEQ ID NO: 8733 - DNA, 27 bp, Artificial Sequence
  Synthetic oligonucleotide
gaatgcacaaacaattgatgtaaacca

SEQ ID NO: 8734 - DNA, 27 bp, Artificial Sequence
  Synthetic oligonucleotide
taaaccaagagacatctgacttggatc

SEQ ID NO: 8735 - DNA, 27 bp, Artificial Sequence
  Synthetic oligonucleotide
aaaccaagagacatctgacttggatcc

SEQ ID NO: 8736 - DNA, 27 bp, Artificial Sequence
  Synthetic oligonucleotide
aaccaagagacatctgacttggatcca

SEQ ID NO: 8737 - DNA, 27 bp, Artificial Sequence
  Synthetic oligonucleotide
gcaaaagtgtaacacgtgttgatgatg

SEQ ID NO: 8738 - DNA, 27 bp, Artificial Sequence
  Synthetic oligonucleotide
caaaagtgtaacacgtgttgatgatgg

SEQ ID NO: 8739 - DNA, 27 bp, Artificial Sequence
  Synthetic oligonucleotide
aaaagtgtaacacgtgttgatgatgga

SEQ ID NO: 8740 - DNA, 27 bp, Artificial Sequence
  Synthetic oligonucleotide
aaagtgtaacacgtgttgatgatggag

SEQ ID NO: 8741 - DNA, 27 bp, Artificial Sequence
  Synthetic oligonucleotide
aagtgtaacacgtgttgatgatggagt

SEQ ID NO: 8742 - DNA, 27 bp, Artificial Sequence
  Synthetic oligonucleotide
agtgtaacacgtgttgatgatggagta

SEQ ID NO: 8743 - DNA, 27 bp, Artificial Sequence
  Synthetic oligonucleotide
gtgtaacacgtgttgatgatggagtag

SEQ ID NO: 8744 - DNA, 27 bp, Artificial Sequence
  Synthetic oligonucleotide
tgtaacacgtgttgatgatggagtagc

SEQ ID NO: 8745 - DNA, 27 bp, Artificial Sequence
  Synthetic oligonucleotide
gtaacacgtgttgatgatggagtagct

SEQ ID NO: 8746 - DNA, 27 bp, Artificial Sequence
  Synthetic oligonucleotide
taacacgtgttgatgatggagtagctt

SEQ ID NO: 8747 - DNA, 27 bp, Artificial Sequence
  Synthetic oligonucleotide
aacacgtgttgatgatggagtagcttc

SEQ ID NO: 8748 - DNA, 27 bp, Artificial Sequence
  Synthetic oligonucleotide
acacgtgttgatgatggagtagcttcc

SEQ ID NO: 8749 - DNA, 27 bp, Artificial Sequence
  Synthetic oligonucleotide
cacgtgttgatgatggagtagcttcct

SEQ ID NO: 8750 - DNA, 27 bp, Artificial Sequence
  Synthetic oligonucleotide
acgtgttgatgatggagtagcttcctt

SEQ ID NO: 8751 - DNA, 27 bp, Artificial Sequence
  Synthetic oligonucleotide
cgtgttgatgatggagtagcttccttt

SEQ ID NO: 8752 - DNA, 27 bp, Artificial Sequence
  Synthetic oligonucleotide
gtgttgatgatggagtagcttcctttg

SEQ ID NO: 8753 - DNA, 27 bp, Artificial Sequence
  Synthetic oligonucleotide
tgttgatgatggagtagcttcctttgt

SEQ ID NO: 8754 - DNA, 27 bp, Artificial Sequence
  Synthetic oligonucleotide
gcttaatctcccatctggagtgacggt

SEQ ID NO: 8755 - DNA, 27 bp, Artificial Sequence
  Synthetic oligonucleotide
cttaatctcccatctggagtgacggtg

SEQ ID NO: 8756 - DNA, 27 bp, Artificial Sequence
  Synthetic oligonucleotide
ttaatctcccatctggagtgacggtgc

SEQ ID NO: 8757 - DNA, 27 bp, Artificial Sequence
  Synthetic oligonucleotide
taatctcccatctggagtgacggtgct

SEQ ID NO: 8758 - DNA, 27 bp, Artificial Sequence
  Synthetic oligonucleotide
aatctcccatctggagtgacggtgctg

SEQ ID NO: 8759 - DNA, 27 bp, Artificial Sequence
  Synthetic oligonucleotide
tctcccatctggagtgacggtgctgga

SEQ ID NO: 8760 - DNA, 27 bp, Artificial Sequence
  Synthetic oligonucleotide
tcccatctggagtgacggtgctggagt

SEQ ID NO: 8761 - DNA, 27 bp, Artificial Sequence
  Synthetic oligonucleotide
cccatctggagtgacggtgctggagtt

SEQ ID NO: 8762 - DNA, 27 bp, Artificial Sequence
  Synthetic oligonucleotide
ccatctggagtgacggtgctggagttt

SEQ ID NO: 8763 - DNA, 27 bp, Artificial Sequence
  Synthetic oligonucleotide
catctggagtgacggtgctggagttta

SEQ ID NO: 8764 - DNA, 27 bp, Artificial Sequence
  Synthetic oligonucleotide
atctggagtgacggtgctggagtttaa

SEQ ID NO: 8765 - DNA, 27 bp, Artificial Sequence
  Synthetic oligonucleotide
tctggagtgacggtgctggagtttaat

SEQ ID NO: 8766 - DNA, 27 bp, Artificial Sequence
  Synthetic oligonucleotide
ctggagtgacggtgctggagtttaatg

SEQ ID NO: 8767 - DNA, 27 bp, Artificial Sequence
  Synthetic oligonucleotide
tggagtgacggtgctggagtttaatgt

SEQ ID NO: 8768 - DNA, 27 bp, Artificial Sequence
  Synthetic oligonucleotide
ggagtgacggtgctggagtttaatgtc

SEQ ID NO: 8769 - DNA, 27 bp, Artificial Sequence
  Synthetic oligonucleotide
gagtgacggtgctggagtttaatgtca

SEQ ID NO: 8770 - DNA, 27 bp, Artificial Sequence
  Synthetic oligonucleotide
agtgacggtgctggagtttaatgtcaa

SEQ ID NO: 8771 - DNA, 27 bp, Artificial Sequence
  Synthetic oligonucleotide
gtgacggtgctggagtttaatgtcaaa

SEQ ID NO: 8772 - DNA, 27 bp, Artificial Sequence
  Synthetic oligonucleotide
tgacggtgctggagtttaatgtcaaaa

SEQ ID NO: 8773 - DNA, 27 bp, Artificial Sequence
  Synthetic oligonucleotide
gacggtgctggagtttaatgtcaaaac

SEQ ID NO: 8774 - DNA, 27 bp, Artificial Sequence
  Synthetic oligonucleotide
acggtgctggagtttaatgtcaaaact

SEQ ID NO: 8775 - DNA, 27 bp, Artificial Sequence
  Synthetic oligonucleotide
cggtgctggagtttaatgtcaaaactg

SEQ ID NO: 8776 - DNA, 27 bp, Artificial Sequence
  Synthetic oligonucleotide
ggtgctggagtttaatgtcaaaactga

SEQ ID NO: 8777 - DNA, 27 bp, Artificial Sequence
  Synthetic oligonucleotide
gtgctggagtttaatgtcaaaactgat

SEQ ID NO: 8778 - DNA, 27 bp, Artificial Sequence
  Synthetic oligonucleotide
tgctggagtttaatgtcaaaactgatg

SEQ ID NO: 8779 - DNA, 27 bp, Artificial Sequence
  Synthetic oligonucleotide
gctggagtttaatgtcaaaactgatgc

SEQ ID NO: 8780 - DNA, 27 bp, Artificial Sequence
  Synthetic oligonucleotide
ctggagtttaatgtcaaaactgatgct

SEQ ID NO: 8781 - DNA, 27 bp, Artificial Sequence
  Synthetic oligonucleotide
tggagtttaatgtcaaaactgatgctc

SEQ ID NO: 8782 - DNA, 27 bp, Artificial Sequence
  Synthetic oligonucleotide
ggagtttaatgtcaaaactgatgctcc

SEQ ID NO: 8783 - DNA, 27 bp, Artificial Sequence
  Synthetic oligonucleotide
gagtttaatgtcaaaactgatgctcca

SEQ ID NO: 8784 - DNA, 27 bp, Artificial Sequence
  Synthetic oligonucleotide
agtttaatgtcaaaactgatgctccag

SEQ ID NO: 8785 - DNA, 27 bp, Artificial Sequence
  Synthetic oligonucleotide
gtttaatgtcaaaactgatgctccaga

SEQ ID NO: 8786 - DNA, 27 bp, Artificial Sequence
  Synthetic oligonucleotide
tttaatgtcaaaactgatgctccagat

SEQ ID NO: 8787 - DNA, 27 bp, Artificial Sequence
  Synthetic oligonucleotide
ttaatgtcaaaactgatgctccagatc

SEQ ID NO: 8788 - DNA, 27 bp, Artificial Sequence
  Synthetic oligonucleotide
taatgtcaaaactgatgctccagatct

SEQ ID NO: 8789 - DNA, 27 bp, Artificial Sequence
  Synthetic oligonucleotide
aatgtcaaaactgatgctccagatctt

SEQ ID NO: 8790 - DNA, 27 bp, Artificial Sequence
  Synthetic oligonucleotide
atgtcaaaactgatgctccagatcttc

SEQ ID NO: 8791 - DNA, 27 bp, Artificial Sequence
  Synthetic oligonucleotide
tgtcaaaactgatgctccagatcttcc

SEQ ID NO: 8792 - DNA, 27 bp, Artificial Sequence
  Synthetic oligonucleotide
gtcaaaactgatgctccagatcttcca

SEQ ID NO: 8793 - DNA, 27 bp, Artificial Sequence
  Synthetic oligonucleotide
tcaaaactgatgctccagatcttccag

SEQ ID NO: 8794 - DNA, 27 bp, Artificial Sequence
  Synthetic oligonucleotide
caaaactgatgctccagatcttccaga

SEQ ID NO: 8795 - DNA, 27 bp, Artificial Sequence
  Synthetic oligonucleotide
aaaactgatgctccagatcttccagaa

SEQ ID NO: 8796 - DNA, 27 bp, Artificial Sequence
  Synthetic oligonucleotide
aaactgatgctccagatcttccagaag

SEQ ID NO: 8797 - DNA, 27 bp, Artificial Sequence
  Synthetic oligonucleotide
aactgatgctccagatcttccagaaga

SEQ ID NO: 8798 - DNA, 27 bp, Artificial Sequence
  Synthetic oligonucleotide
actgatgctccagatcttccagaagaa

SEQ ID NO: 8799 - DNA, 27 bp, Artificial Sequence
  Synthetic oligonucleotide
ctgatgctccagatcttccagaagaaa

SEQ ID NO: 8800 - DNA, 27 bp, Artificial Sequence
  Synthetic oligonucleotide
tgatgctccagatcttccagaagaaaa

SEQ ID NO: 8801 - DNA, 27 bp, Artificial Sequence
  Synthetic oligonucleotide
aagaaaatcaggccagggaaggttacc

SEQ ID NO: 8802 - DNA, 27 bp, Artificial Sequence
  Synthetic oligonucleotide
agaaaatcaggccagggaaggttaccg

SEQ ID NO: 8803 - DNA, 27 bp, Artificial Sequence
  Synthetic oligonucleotide
gaaaatcaggccagggaaggttaccga

SEQ ID NO: 8804 - DNA, 27 bp, Artificial Sequence
  Synthetic oligonucleotide
aaaatcaggccagggaaggttaccgag

SEQ ID NO: 8805 - DNA, 27 bp, Artificial Sequence
  Synthetic oligonucleotide
aaatcaggccagggaaggttaccgagc

SEQ ID NO: 8806 - DNA, 27 bp, Artificial Sequence
  Synthetic oligonucleotide
aatcaggccagggaaggttaccgagca

SEQ ID NO: 8807 - DNA, 27 bp, Artificial Sequence
  Synthetic oligonucleotide
atcaggccagggaaggttaccgagcaa

SEQ ID NO: 8808 - DNA, 27 bp, Artificial Sequence
  Synthetic oligonucleotide
tcaggccagggaaggttaccgagcaat

SEQ ID NO: 8809 - DNA, 27 bp, Artificial Sequence
  Synthetic oligonucleotide
caggccagggaaggttaccgagcaata

SEQ ID NO: 8810 - DNA, 27 bp, Artificial Sequence
  Synthetic oligonucleotide
aggccagggaaggttaccgagcaatag

SEQ ID NO: 8811 - DNA, 27 bp, Artificial Sequence
  Synthetic oligonucleotide
ggccagggaaggttaccgagcaatagc

SEQ ID NO: 8812 - DNA, 27 bp, Artificial Sequence
  Synthetic oligonucleotide
gccagggaaggttaccgagcaatagca

SEQ ID NO: 8813 - DNA, 27 bp, Artificial Sequence
  Synthetic oligonucleotide
ccagggaaggttaccgagcaatagcat

SEQ ID NO: 8814 - DNA, 27 bp, Artificial Sequence
  Synthetic oligonucleotide
cagggaaggttaccgagcaatagcata

SEQ ID NO: 8815 - DNA, 27 bp, Artificial Sequence
  Synthetic oligonucleotide
agggaaggttaccgagcaatagcatac

SEQ ID NO: 8816 - DNA, 27 bp, Artificial Sequence
  Synthetic oligonucleotide
gggaaggttaccgagcaatagcatact

SEQ ID NO: 8817 - DNA, 27 bp, Artificial Sequence
  Synthetic oligonucleotide
ggaaggttaccgagcaatagcatactc

SEQ ID NO: 8818 - DNA, 27 bp, Artificial Sequence
  Synthetic oligonucleotide
gaaggttaccgagcaatagcatactca

SEQ ID NO: 8819 - DNA, 27 bp, Artificial Sequence
  Synthetic oligonucleotide
aggttaccgagcaatagcatactcatc

SEQ ID NO: 8820 - DNA, 27 bp, Artificial Sequence
  Synthetic oligonucleotide
ggttaccgagcaatagcatactcatct

SEQ ID NO: 8821 - DNA, 27 bp, Artificial Sequence
  Synthetic oligonucleotide
gttaccgagcaatagcatactcatctc

SEQ ID NO: 8822 - DNA, 27 bp, Artificial Sequence
  Synthetic oligonucleotide
ttaccgagcaatagcatactcatctct

SEQ ID NO: 8823 - DNA, 27 bp, Artificial Sequence
  Synthetic oligonucleotide
taccgagcaatagcatactcatctctc

SEQ ID NO: 8824 - DNA, 27 bp, Artificial Sequence
  Synthetic oligonucleotide
accgagcaatagcatactcatctctca

SEQ ID NO: 8825 - DNA, 27 bp, Artificial Sequence
  Synthetic oligonucleotide
ccgagcaatagcatactcatctctcag

SEQ ID NO: 8826 - DNA, 27 bp, Artificial Sequence
  Synthetic oligonucleotide
cgagcaatagcatactcatctctcagc

SEQ ID NO: 8827 - DNA, 27 bp, Artificial Sequence
  Synthetic oligonucleotide
gagcaatagcatactcatctctcagcc

SEQ ID NO: 8828 - DNA, 27 bp, Artificial Sequence
  Synthetic oligonucleotide
agcaatagcatactcatctctcagcca

SEQ ID NO: 8829 - DNA, 27 bp, Artificial Sequence
  Synthetic oligonucleotide
gcaatagcatactcatctctcagccaa

SEQ ID NO: 8830 - DNA, 27 bp, Artificial Sequence
  Synthetic oligonucleotide
caatagcatactcatctctcagccaaa

SEQ ID NO: 8831 - DNA, 27 bp, Artificial Sequence
  Synthetic oligonucleotide
aatagcatactcatctctcagccaaag

SEQ ID NO: 8832 - DNA, 27 bp, Artificial Sequence
  Synthetic oligonucleotide
atagcatactcatctctcagccaaagt

SEQ ID NO: 8833 - DNA, 27 bp, Artificial Sequence
  Synthetic oligonucleotide
tagcatactcatctctcagccaaagtt

SEQ ID NO: 8834 - DNA, 27 bp, Artificial Sequence
  Synthetic oligonucleotide
agcatactcatctctcagccaaagtta

SEQ ID NO: 8835 - DNA, 27 bp, Artificial Sequence
  Synthetic oligonucleotide
gcatactcatctctcagccaaagttac

SEQ ID NO: 8836 - DNA, 27 bp, Artificial Sequence
  Synthetic oligonucleotide
catactcatctctcagccaaagttacc

SEQ ID NO: 8837 - DNA, 27 bp, Artificial Sequence
  Synthetic oligonucleotide
atactcatctctcagccaaagttacct

SEQ ID NO: 8838 - DNA, 27 bp, Artificial Sequence
  Synthetic oligonucleotide
tactcatctctcagccaaagttacctt

SEQ ID NO: 8839 - DNA, 27 bp, Artificial Sequence
  Synthetic oligonucleotide
actcatctctcagccaaagttaccttt

SEQ ID NO: 8840 - DNA, 27 bp, Artificial Sequence
  Synthetic oligonucleotide
ctcatctctcagccaaagttaccttta

SEQ ID NO: 8841 - DNA, 27 bp, Artificial Sequence
  Synthetic oligonucleotide
tcatctctcagccaaagttacctttat

SEQ ID NO: 8842 - DNA, 27 bp, Artificial Sequence
  Synthetic oligonucleotide
catctctcagccaaagttacctttata

SEQ ID NO: 8843 - DNA, 27 bp, Artificial Sequence
  Synthetic oligonucleotide
atctctcagccaaagttacctttatat

SEQ ID NO: 8844 - DNA, 27 bp, Artificial Sequence
  Synthetic oligonucleotide
tctctcagccaaagttacctttatatt

SEQ ID NO: 8845 - DNA, 27 bp, Artificial Sequence
  Synthetic oligonucleotide
ctctcagccaaagttacctttatattg

SEQ ID NO: 8846 - DNA, 27 bp, Artificial Sequence
  Synthetic oligonucleotide
ataaggctttgctagtgggagaacatc

SEQ ID NO: 8847 - DNA, 27 bp, Artificial Sequence
  Synthetic oligonucleotide
taaggctttgctagtgggagaacatct

SEQ ID NO: 8848 - DNA, 27 bp, Artificial Sequence
  Synthetic oligonucleotide
aaggctttgctagtgggagaacatctg

SEQ ID NO: 8849 - DNA, 27 bp, Artificial Sequence
  Synthetic oligonucleotide
ccccaaaagcccatatattgacaaaat

SEQ ID NO: 8850 - DNA, 27 bp, Artificial Sequence
  Synthetic oligonucleotide
cccaaaagcccatatattgacaaaata

SEQ ID NO: 8851 - DNA, 27 bp, Artificial Sequence
  Synthetic oligonucleotide
caaaagcccatatattgacaaaataac

SEQ ID NO: 8852 - DNA, 27 bp, Artificial Sequence
  Synthetic oligonucleotide
aaaagcccatatattgacaaaataact

SEQ ID NO: 8853 - DNA, 27 bp, Artificial Sequence
  Synthetic oligonucleotide
aaagcccatatattgacaaaataactc

SEQ ID NO: 8854 - DNA, 27 bp, Artificial Sequence
  Synthetic oligonucleotide
gcccatatattgacaaaataactcact

SEQ ID NO: 8855 - DNA, 27 bp, Artificial Sequence
  Synthetic oligonucleotide
atatattgacaaaataactcactataa

SEQ ID NO: 8856 - DNA, 27 bp, Artificial Sequence
  Synthetic oligonucleotide
tatattgacaaaataactcactataat

SEQ ID NO: 8857 - DNA, 27 bp, Artificial Sequence
  Synthetic oligonucleotide
tattgacaaaataactcactataatta

SEQ ID NO: 8858 - DNA, 27 bp, Artificial Sequence
  Synthetic oligonucleotide
attacttgattttatccaagggcaaaa

SEQ ID NO: 8859 - DNA, 27 bp, Artificial Sequence
  Synthetic oligonucleotide
ttacttgattttatccaagggcaaaat

SEQ ID NO: 8860 - DNA, 27 bp, Artificial Sequence
  Synthetic oligonucleotide
tacttgattttatccaagggcaaaatt

SEQ ID NO: 8861 - DNA, 27 bp, Artificial Sequence
  Synthetic oligonucleotide
acttgattttatccaagggcaaaatta

SEQ ID NO: 8862 - DNA, 27 bp, Artificial Sequence
  Synthetic oligonucleotide
cttgattttatccaagggcaaaattat

SEQ ID NO: 8863 - DNA, 27 bp, Artificial Sequence
  Synthetic oligonucleotide
ttgattttatccaagggcaaaattatc

SEQ ID NO: 8864 - DNA, 27 bp, Artificial Sequence
  Synthetic oligonucleotide
tgattttatccaagggcaaaattatcc

SEQ ID NO: 8865 - DNA, 27 bp, Artificial Sequence
  Synthetic oligonucleotide
gattttatccaagggcaaaattatcca

SEQ ID NO: 8866 - DNA, 27 bp, Artificial Sequence
  Synthetic oligonucleotide
attttatccaagggcaaaattatccac

SEQ ID NO: 8867 - DNA, 27 bp, Artificial Sequence
  Synthetic oligonucleotide
ttttatccaagggcaaaattatccact

SEQ ID NO: 8868 - DNA, 27 bp, Artificial Sequence
  Synthetic oligonucleotide
tttatccaagggcaaaattatccactt

SEQ ID NO: 8869 - DNA, 27 bp, Artificial Sequence
  Synthetic oligonucleotide
ttatccaagggcaaaattatccacttt

SEQ ID NO: 8870 - DNA, 27 bp, Artificial Sequence
  Synthetic oligonucleotide
tatccaagggcaaaattatccactttg

SEQ ID NO: 8871 - DNA, 27 bp, Artificial Sequence
  Synthetic oligonucleotide
atccaagggcaaaattatccactttgg

SEQ ID NO: 8872 - DNA, 27 bp, Artificial Sequence
  Synthetic oligonucleotide
tccaagggcaaaattatccactttggc

SEQ ID NO: 8873 - DNA, 27 bp, Artificial Sequence
  Synthetic oligonucleotide
ccaagggcaaaattatccactttggca

SEQ ID NO: 8874 - DNA, 27 bp, Artificial Sequence
  Synthetic oligonucleotide
caagggcaaaattatccactttggcac

SEQ ID NO: 8875 - DNA, 27 bp, Artificial Sequence
  Synthetic oligonucleotide
aagggcaaaattatccactttggcacg

SEQ ID NO: 8876 - DNA, 27 bp, Artificial Sequence
  Synthetic oligonucleotide
agggcaaaattatccactttggcacga

SEQ ID NO: 8877 - DNA, 27 bp, Artificial Sequence
  Synthetic oligonucleotide
gggcaaaattatccactttggcacgag

SEQ ID NO: 8878 - DNA, 27 bp, Artificial Sequence
  Synthetic oligonucleotide
ggcaaaattatccactttggcacgagg

SEQ ID NO: 8879 - DNA, 27 bp, Artificial Sequence
  Synthetic oligonucleotide
gcaaaattatccactttggcacgaggg

SEQ ID NO: 8880 - DNA, 27 bp, Artificial Sequence
  Synthetic oligonucleotide
caaaattatccactttggcacgaggga

SEQ ID NO: 8881 - DNA, 27 bp, Artificial Sequence
  Synthetic oligonucleotide
attttcagatgcatcttatcaaagtat

SEQ ID NO: 8882 - DNA, 27 bp, Artificial Sequence
  Synthetic oligonucleotide
ttttcagatgcatcttatcaaagtata

SEQ ID NO: 8883 - DNA, 27 bp, Artificial Sequence
  Synthetic oligonucleotide
tttcagatgcatcttatcaaagtataa

SEQ ID NO: 8884 - DNA, 27 bp, Artificial Sequence
  Synthetic oligonucleotide
ttcagatgcatcttatcaaagtataaa

SEQ ID NO: 8885 - DNA, 27 bp, Artificial Sequence
  Synthetic oligonucleotide
tcagatgcatcttatcaaagtataaac

SEQ ID NO: 8886 - DNA, 27 bp, Artificial Sequence
  Synthetic oligonucleotide
cagatgcatcttatcaaagtataaaca

SEQ ID NO: 8887 - DNA, 27 bp, Artificial Sequence
  Synthetic oligonucleotide
agatgcatcttatcaaagtataaacat

SEQ ID NO: 8888 - DNA, 27 bp, Artificial Sequence
  Synthetic oligonucleotide
gatgcatcttatcaaagtataaacatt

SEQ ID NO: 8889 - DNA, 27 bp, Artificial Sequence
  Synthetic oligonucleotide
atgcatcttatcaaagtataaacattc

SEQ ID NO: 8890 - DNA, 27 bp, Artificial Sequence
  Synthetic oligonucleotide
tgcatcttatcaaagtataaacattcc

SEQ ID NO: 8891 - DNA, 27 bp, Artificial Sequence
  Synthetic oligonucleotide
gcatcttatcaaagtataaacattcca

SEQ ID NO: 8892 - DNA, 27 bp, Artificial Sequence
  Synthetic oligonucleotide
catcttatcaaagtataaacattccag

SEQ ID NO: 8893 - DNA, 27 bp, Artificial Sequence
  Synthetic oligonucleotide
atcttatcaaagtataaacattccagt

SEQ ID NO: 8894 - DNA, 27 bp, Artificial Sequence
  Synthetic oligonucleotide
tcttatcaaagtataaacattccagta

SEQ ID NO: 8895 - DNA, 27 bp, Artificial Sequence
  Synthetic oligonucleotide
cttatcaaagtataaacattccagtaa

SEQ ID NO: 8896 - DNA, 27 bp, Artificial Sequence
  Synthetic oligonucleotide
ttatcaaagtataaacattccagtaac

SEQ ID NO: 8897 - DNA, 27 bp, Artificial Sequence
  Synthetic oligonucleotide
tatcaaagtataaacattccagtaaca

SEQ ID NO: 8898 - DNA, 27 bp, Artificial Sequence
  Synthetic oligonucleotide
atcaaagtataaacattccagtaacac

SEQ ID NO: 8899 - DNA, 27 bp, Artificial Sequence
  Synthetic oligonucleotide
cacagaacatggttccttcatcccgac

SEQ ID NO: 8900 - DNA, 27 bp, Artificial Sequence
  Synthetic oligonucleotide
acagaacatggttccttcatcccgact

SEQ ID NO: 8901 - DNA, 27 bp, Artificial Sequence
  Synthetic oligonucleotide
cagaacatggttccttcatcccgactt

SEQ ID NO: 8902 - DNA, 27 bp, Artificial Sequence
  Synthetic oligonucleotide
agaacatggttccttcatcccgacttc

SEQ ID NO: 8903 - DNA, 27 bp, Artificial Sequence
  Synthetic oligonucleotide
gaacatggttccttcatcccgacttct

SEQ ID NO: 8904 - DNA, 27 bp, Artificial Sequence
  Synthetic oligonucleotide
aacatggttccttcatcccgacttctg

SEQ ID NO: 8905 - DNA, 27 bp, Artificial Sequence
  Synthetic oligonucleotide
acatggttccttcatcccgacttctgg

SEQ ID NO: 8906 - DNA, 27 bp, Artificial Sequence
  Synthetic oligonucleotide
catggttccttcatcccgacttctggt

SEQ ID NO: 8907 - DNA, 27 bp, Artificial Sequence
  Synthetic oligonucleotide
ttctggtctattacatcgtcacaggag

SEQ ID NO: 8908 - DNA, 27 bp, Artificial Sequence
  Synthetic oligonucleotide
tctggtctattacatcgtcacaggaga

SEQ ID NO: 8909 - DNA, 27 bp, Artificial Sequence
  Synthetic oligonucleotide
ctggtctattacatcgtcacaggagaa

SEQ ID NO: 8910 - DNA, 27 bp, Artificial Sequence
  Synthetic oligonucleotide
tggtctattacatcgtcacaggagaac

SEQ ID NO: 8911 - DNA, 27 bp, Artificial Sequence
  Synthetic oligonucleotide
ggtctattacatcgtcacaggagaaca

SEQ ID NO: 8912 - DNA, 27 bp, Artificial Sequence
  Synthetic oligonucleotide
gtctattacatcgtcacaggagaacag

SEQ ID NO: 8913 - DNA, 27 bp, Artificial Sequence
  Synthetic oligonucleotide
tctattacatcgtcacaggagaacaga

SEQ ID NO: 8914 - DNA, 27 bp, Artificial Sequence
  Synthetic oligonucleotide
ctattacatcgtcacaggagaacagac

SEQ ID NO: 8915 - DNA, 27 bp, Artificial Sequence
  Synthetic oligonucleotide
aacagacagcagaattagtgtctgatt

SEQ ID NO: 8916 - DNA, 27 bp, Artificial Sequence
  Synthetic oligonucleotide
acagacagcagaattagtgtctgattc

SEQ ID NO: 8917 - DNA, 27 bp, Artificial Sequence
  Synthetic oligonucleotide
cagacagcagaattagtgtctgattca

SEQ ID NO: 8918 - DNA, 27 bp, Artificial Sequence
  Synthetic oligonucleotide
agacagcagaattagtgtctgattcag

SEQ ID NO: 8919 - DNA, 27 bp, Artificial Sequence
  Synthetic oligonucleotide
gacagcagaattagtgtctgattcagt

SEQ ID NO: 8920 - DNA, 27 bp, Artificial Sequence
  Synthetic oligonucleotide
acagcagaattagtgtctgattcagtc

SEQ ID NO: 8921 - DNA, 27 bp, Artificial Sequence
  Synthetic oligonucleotide
cagcagaattagtgtctgattcagtct

SEQ ID NO: 8922 - DNA, 27 bp, Artificial Sequence
  Synthetic oligonucleotide
agcagaattagtgtctgattcagtctg

SEQ ID NO: 8923 - DNA, 27 bp, Artificial Sequence
  Synthetic oligonucleotide
gcagaattagtgtctgattcagtctgg

SEQ ID NO: 8924 - DNA, 27 bp, Artificial Sequence
  Synthetic oligonucleotide
cagaattagtgtctgattcagtctggt

SEQ ID NO: 8925 - DNA, 27 bp, Artificial Sequence
  Synthetic oligonucleotide
agaattagtgtctgattcagtctggtt

SEQ ID NO: 8926 - DNA, 27 bp, Artificial Sequence
  Synthetic oligonucleotide
gaattagtgtctgattcagtctggtta

SEQ ID NO: 8927 - DNA, 27 bp, Artificial Sequence
  Synthetic oligonucleotide
aattagtgtctgattcagtctggttaa

SEQ ID NO: 8928 - DNA, 27 bp, Artificial Sequence
  Synthetic oligonucleotide
attagtgtctgattcagtctggttaaa

SEQ ID NO: 8929 - DNA, 27 bp, Artificial Sequence
  Synthetic oligonucleotide
ttagtgtctgattcagtctggttaaat

SEQ ID NO: 8930 - DNA, 27 bp, Artificial Sequence
  Synthetic oligonucleotide
tagtgtctgattcagtctggttaaata

SEQ ID NO: 8931 - DNA, 27 bp, Artificial Sequence
  Synthetic oligonucleotide
agtgtctgattcagtctggttaaatat

SEQ ID NO: 8932 - DNA, 27 bp, Artificial Sequence
  Synthetic oligonucleotide
tgtctgattcagtctggttaaatattg

SEQ ID NO: 8933 - DNA, 27 bp, Artificial Sequence
  Synthetic oligonucleotide
gattcagtctggttaaatattgaagaa

SEQ ID NO: 8934 - DNA, 27 bp, Artificial Sequence
  Synthetic oligonucleotide
tggttaaatattgaagaaaaatgtggc

SEQ ID NO: 8935 - DNA, 27 bp, Artificial Sequence
  Synthetic oligonucleotide
ggttaaatattgaagaaaaatgtggca

SEQ ID NO: 8936 - DNA, 27 bp, Artificial Sequence
  Synthetic oligonucleotide
gttaaatattgaagaaaaatgtggcaa

SEQ ID NO: 8937 - DNA, 27 bp, Artificial Sequence
  Synthetic oligonucleotide
ttaaatattgaagaaaaatgtggcaac

SEQ ID NO: 8938 - DNA, 27 bp, Artificial Sequence
  Synthetic oligonucleotide
taaatattgaagaaaaatgtggcaacc

SEQ ID NO: 8939 - DNA, 27 bp, Artificial Sequence
  Synthetic oligonucleotide
aaatattgaagaaaaatgtggcaacca

SEQ ID NO: 8940 - DNA, 27 bp, Artificial Sequence
  Synthetic oligonucleotide
aatattgaagaaaaatgtggcaaccag

SEQ ID NO: 8941 - DNA, 27 bp, Artificial Sequence
  Synthetic oligonucleotide
atattgaagaaaaatgtggcaaccagc

SEQ ID NO: 8942 - DNA, 27 bp, Artificial Sequence
  Synthetic oligonucleotide
tattgaagaaaaatgtggcaaccagct

SEQ ID NO: 8943 - DNA, 27 bp, Artificial Sequence
  Synthetic oligonucleotide
attgaagaaaaatgtggcaaccagctc

SEQ ID NO: 8944 - DNA, 27 bp, Artificial Sequence
  Synthetic oligonucleotide
ttgaagaaaaatgtggcaaccagctcc

SEQ ID NO: 8945 - DNA, 27 bp, Artificial Sequence
  Synthetic oligonucleotide
tgaagaaaaatgtggcaaccagctcca

SEQ ID NO: 8946 - DNA, 27 bp, Artificial Sequence
  Synthetic oligonucleotide
gaagaaaaatgtggcaaccagctccag

SEQ ID NO: 8947 - DNA, 27 bp, Artificial Sequence
  Synthetic oligonucleotide
aagaaaaatgtggcaaccagctccagg

SEQ ID NO: 8948 - DNA, 27 bp, Artificial Sequence
  Synthetic oligonucleotide
agaaaaatgtggcaaccagctccaggt

SEQ ID NO: 8949 - DNA, 27 bp, Artificial Sequence
  Synthetic oligonucleotide
gaaaaatgtggcaaccagctccaggtt

SEQ ID NO: 8950 - DNA, 27 bp, Artificial Sequence
  Synthetic oligonucleotide
aaaaatgtggcaaccagctccaggttc

SEQ ID NO: 8951 - DNA, 27 bp, Artificial Sequence
  Synthetic oligonucleotide
aaaatgtggcaaccagctccaggttca

SEQ ID NO: 8952 - DNA, 27 bp, Artificial Sequence
  Synthetic oligonucleotide
aaatgtggcaaccagctccaggttcat

SEQ ID NO: 8953 - DNA, 27 bp, Artificial Sequence
  Synthetic oligonucleotide
tgtggcaaccagctccaggttcatctg

SEQ ID NO: 8954 - DNA, 27 bp, Artificial Sequence
  Synthetic oligonucleotide
gtggcaaccagctccaggttcatctgt

SEQ ID NO: 8955 - DNA, 27 bp, Artificial Sequence
  Synthetic oligonucleotide
tggcaaccagctccaggttcatctgtc

SEQ ID NO: 8956 - DNA, 27 bp, Artificial Sequence
  Synthetic oligonucleotide
ggcaaccagctccaggttcatctgtct

SEQ ID NO: 8957 - DNA, 27 bp, Artificial Sequence
  Synthetic oligonucleotide
gcaaccagctccaggttcatctgtctc

SEQ ID NO: 8958 - DNA, 27 bp, Artificial Sequence
  Synthetic oligonucleotide
caaccagctccaggttcatctgtctcc

SEQ ID NO: 8959 - DNA, 27 bp, Artificial Sequence
  Synthetic oligonucleotide
aaccagctccaggttcatctgtctcct

SEQ ID NO: 8960 - DNA, 27 bp, Artificial Sequence
  Synthetic oligonucleotide
accagctccaggttcatctgtctcctg

SEQ ID NO: 8961 - DNA, 27 bp, Artificial Sequence
  Synthetic oligonucleotide
ccagctccaggttcatctgtctcctga

SEQ ID NO: 8962 - DNA, 27 bp, Artificial Sequence
  Synthetic oligonucleotide
cagctccaggttcatctgtctcctgat

SEQ ID NO: 8963 - DNA, 27 bp, Artificial Sequence
  Synthetic oligonucleotide
agctccaggttcatctgtctcctgatg

SEQ ID NO: 8964 - DNA, 27 bp, Artificial Sequence
  Synthetic oligonucleotide
gctccaggttcatctgtctcctgatgc

SEQ ID NO: 8965 - DNA, 27 bp, Artificial Sequence
  Synthetic oligonucleotide
ctccaggttcatctgtctcctgatgca

SEQ ID NO: 8966 - DNA, 27 bp, Artificial Sequence
  Synthetic oligonucleotide
tccaggttcatctgtctcctgatgcag

SEQ ID NO: 8967 - DNA, 27 bp, Artificial Sequence
  Synthetic oligonucleotide
ccaggttcatctgtctcctgatgcaga

SEQ ID NO: 8968 - DNA, 27 bp, Artificial Sequence
  Synthetic oligonucleotide
caggttcatctgtctcctgatgcagat

SEQ ID NO: 8969 - DNA, 27 bp, Artificial Sequence
  Synthetic oligonucleotide
aggttcatctgtctcctgatgcagatg

SEQ ID NO: 8970 - DNA, 27 bp, Artificial Sequence
  Synthetic oligonucleotide
ggttcatctgtctcctgatgcagatgc

SEQ ID NO: 8971 - DNA, 27 bp, Artificial Sequence
  Synthetic oligonucleotide
gttcatctgtctcctgatgcagatgca

SEQ ID NO: 8972 - DNA, 27 bp, Artificial Sequence
  Synthetic oligonucleotide
ttcatctgtctcctgatgcagatgcat

SEQ ID NO: 8973 - DNA, 27 bp, Artificial Sequence
  Synthetic oligonucleotide
tcatctgtctcctgatgcagatgcata

SEQ ID NO: 8974 - DNA, 27 bp, Artificial Sequence
  Synthetic oligonucleotide
catctgtctcctgatgcagatgcatat

SEQ ID NO: 8975 - DNA, 27 bp, Artificial Sequence
  Synthetic oligonucleotide
gaatggattcctgggtggcattagcag

SEQ ID NO: 8976 - DNA, 27 bp, Artificial Sequence
  Synthetic oligonucleotide
aatggattcctgggtggcattagcagc

SEQ ID NO: 8977 - DNA, 27 bp, Artificial Sequence
  Synthetic oligonucleotide
atggattcctgggtggcattagcagca

SEQ ID NO: 8978 - DNA, 27 bp, Artificial Sequence
  Synthetic oligonucleotide
aggagccaaaaagcccttggaaagagt

SEQ ID NO: 8979 - DNA, 27 bp, Artificial Sequence
  Synthetic oligonucleotide
ggagccaaaaagcccttggaaagagta

SEQ ID NO: 8980 - DNA, 27 bp, Artificial Sequence
  Synthetic oligonucleotide
gagccaaaaagcccttggaaagagtat

SEQ ID NO: 8981 - DNA, 27 bp, Artificial Sequence
  Synthetic oligonucleotide
agccaaaaagcccttggaaagagtatt

SEQ ID NO: 8982 - DNA, 27 bp, Artificial Sequence
  Synthetic oligonucleotide
gccaaaaagcccttggaaagagtattt

SEQ ID NO: 8983 - DNA, 27 bp, Artificial Sequence
  Synthetic oligonucleotide
ccaaaaagcccttggaaagagtatttc

SEQ ID NO: 8984 - DNA, 27 bp, Artificial Sequence
  Synthetic oligonucleotide
caaaaagcccttggaaagagtatttca

SEQ ID NO: 8985 - DNA, 27 bp, Artificial Sequence
  Synthetic oligonucleotide
aaaaagcccttggaaagagtatttcaa

SEQ ID NO: 8986 - DNA, 27 bp, Artificial Sequence
  Synthetic oligonucleotide
aaaagcccttggaaagagtatttcaat

SEQ ID NO: 8987 - DNA, 27 bp, Artificial Sequence
  Synthetic oligonucleotide
aaagcccttggaaagagtatttcaatt

SEQ ID NO: 8988 - DNA, 27 bp, Artificial Sequence
  Synthetic oligonucleotide
aagcccttggaaagagtatttcaattc

SEQ ID NO: 8989 - DNA, 27 bp, Artificial Sequence
  Synthetic oligonucleotide
agcccttggaaagagtatttcaattct

SEQ ID NO: 8990 - DNA, 27 bp, Artificial Sequence
  Synthetic oligonucleotide
gcccttggaaagagtatttcaattctt

SEQ ID NO: 8991 - DNA, 27 bp, Artificial Sequence
  Synthetic oligonucleotide
cccttggaaagagtatttcaattctta

SEQ ID NO: 8992 - DNA, 27 bp, Artificial Sequence
  Synthetic oligonucleotide
ccttggaaagagtatttcaattcttag

SEQ ID NO: 8993 - DNA, 27 bp, Artificial Sequence
  Synthetic oligonucleotide
cttggaaagagtatttcaattcttaga

SEQ ID NO: 8994 - DNA, 27 bp, Artificial Sequence
  Synthetic oligonucleotide
ttggaaagagtatttcaattcttagag

SEQ ID NO: 8995 - DNA, 27 bp, Artificial Sequence
  Synthetic oligonucleotide
tggaaagagtatttcaattcttagaga

SEQ ID NO: 8996 - DNA, 27 bp, Artificial Sequence
  Synthetic oligonucleotide
ggaaagagtatttcaattcttagagaa

SEQ ID NO: 8997 - DNA, 27 bp, Artificial Sequence
  Synthetic oligonucleotide
gaaagagtatttcaattcttagagaag

SEQ ID NO: 8998 - DNA, 27 bp, Artificial Sequence
  Synthetic oligonucleotide
aaagagtatttcaattcttagagaaga

SEQ ID NO: 8999 - DNA, 27 bp, Artificial Sequence
  Synthetic oligonucleotide
aagagtatttcaattcttagagaagag

SEQ ID NO: 9000 - DNA, 27 bp, Artificial Sequence
  Synthetic oligonucleotide
agagtatttcaattcttagagaagagt

SEQ ID NO: 9001 - DNA, 27 bp, Artificial Sequence
  Synthetic oligonucleotide
gagtatttcaattcttagagaagagtg

SEQ ID NO: 9002 - DNA, 27 bp, Artificial Sequence
  Synthetic oligonucleotide
agtatttcaattcttagagaagagtga

SEQ ID NO: 9003 - DNA, 27 bp, Artificial Sequence
  Synthetic oligonucleotide
gtatttcaattcttagagaagagtgat

SEQ ID NO: 9004 - DNA, 27 bp, Artificial Sequence
  Synthetic oligonucleotide
tatttcaattcttagagaagagtgatc

SEQ ID NO: 9005 - DNA, 27 bp, Artificial Sequence
  Synthetic oligonucleotide
atttcaattcttagagaagagtgatct

SEQ ID NO: 9006 - DNA, 27 bp, Artificial Sequence
  Synthetic oligonucleotide
tttcaattcttagagaagagtgatctg

SEQ ID NO: 9007 - DNA, 27 bp, Artificial Sequence
  Synthetic oligonucleotide
ttcaattcttagagaagagtgatctgg

SEQ ID NO: 9008 - DNA, 27 bp, Artificial Sequence
  Synthetic oligonucleotide
tcaattcttagagaagagtgatctggg

SEQ ID NO: 9009 - DNA, 27 bp, Artificial Sequence
  Synthetic oligonucleotide
caattcttagagaagagtgatctgggc

SEQ ID NO: 9010 - DNA, 27 bp, Artificial Sequence
  Synthetic oligonucleotide
aattcttagagaagagtgatctgggct

SEQ ID NO: 9011 - DNA, 27 bp, Artificial Sequence
  Synthetic oligonucleotide
ttcttagagaagagtgatctgggctgt

SEQ ID NO: 9012 - DNA, 27 bp, Artificial Sequence
  Synthetic oligonucleotide
tcttagagaagagtgatctgggctgtg

SEQ ID NO: 9013 - DNA, 27 bp, Artificial Sequence
  Synthetic oligonucleotide
ttagagaagagtgatctgggctgtggg

SEQ ID NO: 9014 - DNA, 27 bp, Artificial Sequence
  Synthetic oligonucleotide
tgtggggcaggtggtggcctcaacaat

SEQ ID NO: 9015 - DNA, 27 bp, Artificial Sequence
  Synthetic oligonucleotide
gggcaggtggtggcctcaacaatgcca

SEQ ID NO: 9016 - DNA, 27 bp, Artificial Sequence
  Synthetic oligonucleotide
ggcaggtggtggcctcaacaatgccaa

SEQ ID NO: 9017 - DNA, 27 bp, Artificial Sequence
  Synthetic oligonucleotide
gcaggtggtggcctcaacaatgccaat

SEQ ID NO: 9018 - DNA, 27 bp, Artificial Sequence
  Synthetic oligonucleotide
caggtggtggcctcaacaatgccaatg

SEQ ID NO: 9019 - DNA, 27 bp, Artificial Sequence
  Synthetic oligonucleotide
aggtggtggcctcaacaatgccaatgt

SEQ ID NO: 9020 - DNA, 27 bp, Artificial Sequence
  Synthetic oligonucleotide
ggtggtggcctcaacaatgccaatgtg

SEQ ID NO: 9021 - DNA, 27 bp, Artificial Sequence
  Synthetic oligonucleotide
gtgttccacctagctggacttaccttc

SEQ ID NO: 9022 - DNA, 27 bp, Artificial Sequence
  Synthetic oligonucleotide
tgttccacctagctggacttaccttcc

SEQ ID NO: 9023 - DNA, 27 bp, Artificial Sequence
  Synthetic oligonucleotide
gttccacctagctggacttaccttcct

SEQ ID NO: 9024 - DNA, 27 bp, Artificial Sequence
  Synthetic oligonucleotide
ttccacctagctggacttaccttcctc

SEQ ID NO: 9025 - DNA, 27 bp, Artificial Sequence
  Synthetic oligonucleotide
tccacctagctggacttaccttcctca

SEQ ID NO: 9026 - DNA, 27 bp, Artificial Sequence
  Synthetic oligonucleotide
ccacctagctggacttaccttcctcac

SEQ ID NO: 9027 - DNA, 27 bp, Artificial Sequence
  Synthetic oligonucleotide
cacctagctggacttaccttcctcact

SEQ ID NO: 9028 - DNA, 27 bp, Artificial Sequence
  Synthetic oligonucleotide
acctagctggacttaccttcctcacta

SEQ ID NO: 9029 - DNA, 27 bp, Artificial Sequence
  Synthetic oligonucleotide
cctagctggacttaccttcctcactaa

SEQ ID NO: 9030 - DNA, 27 bp, Artificial Sequence
  Synthetic oligonucleotide
ctagctggacttaccttcctcactaat

SEQ ID NO: 9031 - DNA, 27 bp, Artificial Sequence
  Synthetic oligonucleotide
tagctggacttaccttcctcactaatg

SEQ ID NO: 9032 - DNA, 27 bp, Artificial Sequence
  Synthetic oligonucleotide
agctggacttaccttcctcactaatgc

SEQ ID NO: 9033 - DNA, 27 bp, Artificial Sequence
  Synthetic oligonucleotide
gctggacttaccttcctcactaatgca

SEQ ID NO: 9034 - DNA, 27 bp, Artificial Sequence
  Synthetic oligonucleotide
ctggacttaccttcctcactaatgcaa

SEQ ID NO: 9035 - DNA, 27 bp, Artificial Sequence
  Synthetic oligonucleotide
tggacttaccttcctcactaatgcaaa

SEQ ID NO: 9036 - DNA, 27 bp, Artificial Sequence
  Synthetic oligonucleotide
ggacttaccttcctcactaatgcaaat

SEQ ID NO: 9037 - DNA, 27 bp, Artificial Sequence
  Synthetic oligonucleotide
gacttaccttcctcactaatgcaaatg

SEQ ID NO: 9038 - DNA, 27 bp, Artificial Sequence
  Synthetic oligonucleotide
acttaccttcctcactaatgcaaatgc

SEQ ID NO: 9039 - DNA, 27 bp, Artificial Sequence
  Synthetic oligonucleotide
cttaccttcctcactaatgcaaatgca

SEQ ID NO: 9040 - DNA, 27 bp, Artificial Sequence
  Synthetic oligonucleotide
ttaccttcctcactaatgcaaatgcag

SEQ ID NO: 9041 - DNA, 27 bp, Artificial Sequence
  Synthetic oligonucleotide
taccttcctcactaatgcaaatgcaga

SEQ ID NO: 9042 - DNA, 27 bp, Artificial Sequence
  Synthetic oligonucleotide
accttcctcactaatgcaaatgcagat

SEQ ID NO: 9043 - DNA, 27 bp, Artificial Sequence
  Synthetic oligonucleotide
ccttcctcactaatgcaaatgcagatg

SEQ ID NO: 9044 - DNA, 27 bp, Artificial Sequence
  Synthetic oligonucleotide
cttcctcactaatgcaaatgcagatga

SEQ ID NO: 9045 - DNA, 27 bp, Artificial Sequence
  Synthetic oligonucleotide
ttcctcactaatgcaaatgcagatgac

SEQ ID NO: 9046 - DNA, 27 bp, Artificial Sequence
  Synthetic oligonucleotide
tcctcactaatgcaaatgcagatgact

SEQ ID NO: 9047 - DNA, 27 bp, Artificial Sequence
  Synthetic oligonucleotide
cctcactaatgcaaatgcagatgactc

SEQ ID NO: 9048 - DNA, 27 bp, Artificial Sequence
  Synthetic oligonucleotide
ctcactaatgcaaatgcagatgactcc

SEQ ID NO: 9049 - DNA, 27 bp, Artificial Sequence
  Synthetic oligonucleotide
tcactaatgcaaatgcagatgactccc

SEQ ID NO: 9050 - DNA, 27 bp, Artificial Sequence
  Synthetic oligonucleotide
cactaatgcaaatgcagatgactccca

SEQ ID NO: 9051 - DNA, 27 bp, Artificial Sequence
  Synthetic oligonucleotide
actaatgcaaatgcagatgactcccaa

SEQ ID NO: 9052 - DNA, 27 bp, Artificial Sequence
  Synthetic oligonucleotide
ctaatgcaaatgcagatgactcccaag

SEQ ID NO: 9053 - DNA, 27 bp, Artificial Sequence
  Synthetic oligonucleotide
taatgcaaatgcagatgactcccaaga

SEQ ID NO: 9054 - DNA, 27 bp, Artificial Sequence
  Synthetic oligonucleotide
aatgcaaatgcagatgactcccaagaa

SEQ ID NO: 9055 - DNA, 27 bp, Artificial Sequence
  Synthetic oligonucleotide
atgcaaatgcagatgactcccaagaaa

SEQ ID NO: 9056 - DNA, 27 bp, Artificial Sequence
  Synthetic oligonucleotide
tgcaaatgcagatgactcccaagaaaa

SEQ ID NO: 9057 - DNA, 27 bp, Artificial Sequence
  Synthetic oligonucleotide
gcaaatgcagatgactcccaagaaaat

SEQ ID NO: 9058 - DNA, 27 bp, Artificial Sequence
  Synthetic oligonucleotide
caaatgcagatgactcccaagaaaatg

SEQ ID NO: 9059 - DNA, 27 bp, Artificial Sequence
  Synthetic oligonucleotide
aaatgcagatgactcccaagaaaatga

SEQ ID NO: 9060 - DNA, 27 bp, Artificial Sequence
  Synthetic oligonucleotide
aatgcagatgactcccaagaaaatgat

SEQ ID NO: 9061 - DNA, 27 bp, Artificial Sequence
  Synthetic oligonucleotide
atgcagatgactcccaagaaaatgatg

SEQ ID NO: 9062 - DNA, 27 bp, Artificial Sequence
  Synthetic oligonucleotide
tgcagatgactcccaagaaaatgatga

SEQ ID NO: 9063 - DNA, 27 bp, Artificial Sequence
  Synthetic oligonucleotide
gcagatgactcccaagaaaatgatgaa

SEQ ID NO: 9064 - DNA, 27 bp, Artificial Sequence
  Synthetic oligonucleotide
cagatgactcccaagaaaatgatgaac

SEQ ID NO: 9065 - DNA, 27 bp, Artificial Sequence
  Synthetic oligonucleotide
agatgactcccaagaaaatgatgaacc

SEQ ID NO: 9066 - DNA, 27 bp, Artificial Sequence
  Synthetic oligonucleotide
gatgactcccaagaaaatgatgaacct

SEQ ID NO: 9067 - DNA, 27 bp, Artificial Sequence
  Synthetic oligonucleotide
atgactcccaagaaaatgatgaacctt

SEQ ID NO: 9068 - DNA, 27 bp, Artificial Sequence
  Synthetic oligonucleotide
tgactcccaagaaaatgatgaaccttg

SEQ ID NO: 9069 - DNA, 27 bp, Artificial Sequence
  Synthetic oligonucleotide
gactcccaagaaaatgatgaaccttgt

SEQ ID NO: 9070 - DNA, 27 bp, Artificial Sequence
  Synthetic oligonucleotide
actcccaagaaaatgatgaaccttgta

SEQ ID NO: 9071 - DNA, 27 bp, Artificial Sequence
  Synthetic oligonucleotide
ctcccaagaaaatgatgaaccttgtaa

SEQ ID NO: 9072 - DNA, 27 bp, Artificial Sequence
  Synthetic oligonucleotide
tcccaagaaaatgatgaaccttgtaaa

SEQ ID NO: 9073 - DNA, 27 bp, Artificial Sequence
  Synthetic oligonucleotide
cccaagaaaatgatgaaccttgtaaag

SEQ ID NO: 9074 - DNA, 27 bp, Artificial Sequence
  Synthetic oligonucleotide
ccaagaaaatgatgaaccttgtaaaga

SEQ ID NO: 9075 - DNA, 27 bp, Artificial Sequence
  Synthetic oligonucleotide
aagaaaatgatgaaccttgtaaagaaa

SEQ ID NO: 9076 - DNA, 27 bp, Artificial Sequence
  Synthetic oligonucleotide
agaaaatgatgaaccttgtaaagaaat

SEQ ID NO: 9077 - DNA, 27 bp, Artificial Sequence
  Synthetic oligonucleotide
gaaaatgatgaaccttgtaaagaaatt

SEQ ID NO: 9078 - DNA, 27 bp, Artificial Sequence
  Synthetic oligonucleotide
aaaatgatgaaccttgtaaagaaattc

SEQ ID NO: 9079 - DNA, 27 bp, Artificial Sequence
  Synthetic oligonucleotide
aatgatgaaccttgtaaagaaattctc

SEQ ID NO: 9080 - DNA, 27 bp, Artificial Sequence
  Synthetic oligonucleotide
gatgaaccttgtaaagaaattctcagg

SEQ ID NO: 9081 - DNA, 27 bp, Artificial Sequence
  Synthetic oligonucleotide
aaagaagatagaagaaatagctgctaa

SEQ ID NO: 9082 - DNA, 27 bp, Artificial Sequence
  Synthetic oligonucleotide
aagaagatagaagaaatagctgctaaa

SEQ ID NO: 9083 - DNA, 27 bp, Artificial Sequence
  Synthetic oligonucleotide
agaagatagaagaaatagctgctaaat

SEQ ID NO: 9084 - DNA, 27 bp, Artificial Sequence
  Synthetic oligonucleotide
gaagatagaagaaatagctgctaaata

SEQ ID NO: 9085 - DNA, 27 bp, Artificial Sequence
  Synthetic oligonucleotide
aagatagaagaaatagctgctaaatat

SEQ ID NO: 9086 - DNA, 27 bp, Artificial Sequence
  Synthetic oligonucleotide
agatagaagaaatagctgctaaatata

SEQ ID NO: 9087 - DNA, 27 bp, Artificial Sequence
  Synthetic oligonucleotide
gatagaagaaatagctgctaaatataa

SEQ ID NO: 9088 - DNA, 27 bp, Artificial Sequence
  Synthetic oligonucleotide
atagaagaaatagctgctaaatataaa

SEQ ID NO: 9089 - DNA, 27 bp, Artificial Sequence
  Synthetic oligonucleotide
tagaagaaatagctgctaaatataaac

SEQ ID NO: 9090 - DNA, 27 bp, Artificial Sequence
  Synthetic oligonucleotide
agaagaaatagctgctaaatataaaca

SEQ ID NO: 9091 - DNA, 27 bp, Artificial Sequence
  Synthetic oligonucleotide
gaagaaatagctgctaaatataaacat

SEQ ID NO: 9092 - DNA, 27 bp, Artificial Sequence
  Synthetic oligonucleotide
aagaaatagctgctaaatataaacatt

SEQ ID NO: 9093 - DNA, 27 bp, Artificial Sequence
  Synthetic oligonucleotide
agaaatagctgctaaatataaacattc

SEQ ID NO: 9094 - DNA, 27 bp, Artificial Sequence
  Synthetic oligonucleotide
gaaatagctgctaaatataaacattca

SEQ ID NO: 9095 - DNA, 27 bp, Artificial Sequence
  Synthetic oligonucleotide
aaatagctgctaaatataaacattcag

SEQ ID NO: 9096 - DNA, 27 bp, Artificial Sequence
  Synthetic oligonucleotide
aatagctgctaaatataaacattcagt

SEQ ID NO: 9097 - DNA, 27 bp, Artificial Sequence
  Synthetic oligonucleotide
atagctgctaaatataaacattcagta

SEQ ID NO: 9098 - DNA, 27 bp, Artificial Sequence
  Synthetic oligonucleotide
tagctgctaaatataaacattcagtag

SEQ ID NO: 9099 - DNA, 27 bp, Artificial Sequence
  Synthetic oligonucleotide
agtagtgaagaaatgttgttacgatgg

SEQ ID NO: 9100 - DNA, 27 bp, Artificial Sequence
  Synthetic oligonucleotide
gtagtgaagaaatgttgttacgatgga

SEQ ID NO: 9101 - DNA, 27 bp, Artificial Sequence
  Synthetic oligonucleotide
tagtgaagaaatgttgttacgatggag

SEQ ID NO: 9102 - DNA, 27 bp, Artificial Sequence
  Synthetic oligonucleotide
agtgaagaaatgttgttacgatggagc

SEQ ID NO: 9103 - DNA, 27 bp, Artificial Sequence
  Synthetic oligonucleotide
gtgaagaaatgttgttacgatggagcc

SEQ ID NO: 9104 - DNA, 27 bp, Artificial Sequence
  Synthetic oligonucleotide
tgaagaaatgttgttacgatggagcct

SEQ ID NO: 9105 - DNA, 27 bp, Artificial Sequence
  Synthetic oligonucleotide
gaagaaatgttgttacgatggagcctg

SEQ ID NO: 9106 - DNA, 27 bp, Artificial Sequence
  Synthetic oligonucleotide
aagaaatgttgttacgatggagcctgc

SEQ ID NO: 9107 - DNA, 27 bp, Artificial Sequence
  Synthetic oligonucleotide
agaaatgttgttacgatggagcctgcg

SEQ ID NO: 9108 - DNA, 27 bp, Artificial Sequence
  Synthetic oligonucleotide
taatgatgaaacctgtgagcagcgagc

SEQ ID NO: 9109 - DNA, 27 bp, Artificial Sequence
  Synthetic oligonucleotide
aatgatgaaacctgtgagcagcgagct

SEQ ID NO: 9110 - DNA, 27 bp, Artificial Sequence
  Synthetic oligonucleotide
atgatgaaacctgtgagcagcgagctg

SEQ ID NO: 9111 - DNA, 27 bp, Artificial Sequence
  Synthetic oligonucleotide
tgatgaaacctgtgagcagcgagctgc

SEQ ID NO: 9112 - DNA, 27 bp, Artificial Sequence
  Synthetic oligonucleotide
gatgaaacctgtgagcagcgagctgca

SEQ ID NO: 9113 - DNA, 27 bp, Artificial Sequence
  Synthetic oligonucleotide
atgaaacctgtgagcagcgagctgcac

SEQ ID NO: 9114 - DNA, 27 bp, Artificial Sequence
  Synthetic oligonucleotide
tgaaacctgtgagcagcgagctgcacg

SEQ ID NO: 9115 - DNA, 27 bp, Artificial Sequence
  Synthetic oligonucleotide
aacctgtgagcagcgagctgcacggat

SEQ ID NO: 9116 - DNA, 27 bp, Artificial Sequence
  Synthetic oligonucleotide
acctgtgagcagcgagctgcacggatt

SEQ ID NO: 9117 - DNA, 27 bp, Artificial Sequence
  Synthetic oligonucleotide
cctgtgagcagcgagctgcacggatta

SEQ ID NO: 9118 - DNA, 27 bp, Artificial Sequence
  Synthetic oligonucleotide
ctgtgagcagcgagctgcacggattag

SEQ ID NO: 9119 - DNA, 27 bp, Artificial Sequence
  Synthetic oligonucleotide
tgtgagcagcgagctgcacggattagt

SEQ ID NO: 9120 - DNA, 27 bp, Artificial Sequence
  Synthetic oligonucleotide
gtgagcagcgagctgcacggattagtt

SEQ ID NO: 9121 - DNA, 27 bp, Artificial Sequence
  Synthetic oligonucleotide
tgagcagcgagctgcacggattagttt

SEQ ID NO: 9122 - DNA, 27 bp, Artificial Sequence
  Synthetic oligonucleotide
gagcagcgagctgcacggattagttta

SEQ ID NO: 9123 - DNA, 27 bp, Artificial Sequence
  Synthetic oligonucleotide
agcagcgagctgcacggattagtttag

SEQ ID NO: 9124 - DNA, 27 bp, Artificial Sequence
  Synthetic oligonucleotide
gcagcgagctgcacggattagtttagg

SEQ ID NO: 9125 - DNA, 27 bp, Artificial Sequence
  Synthetic oligonucleotide
cagcgagctgcacggattagtttaggg

SEQ ID NO: 9126 - DNA, 27 bp, Artificial Sequence
  Synthetic oligonucleotide
gtgtcgtcgcaagccagctccgtgcta

SEQ ID NO: 9127 - DNA, 27 bp, Artificial Sequence
  Synthetic oligonucleotide
tgtcgtcgcaagccagctccgtgctaa

SEQ ID NO: 9128 - DNA, 27 bp, Artificial Sequence
  Synthetic oligonucleotide
gtcgtcgcaagccagctccgtgctaat

SEQ ID NO: 9129 - DNA, 27 bp, Artificial Sequence
  Synthetic oligonucleotide
tcgtcgcaagccagctccgtgctaata

SEQ ID NO: 9130 - DNA, 27 bp, Artificial Sequence
  Synthetic oligonucleotide
cgtcgcaagccagctccgtgctaatat

SEQ ID NO: 9131 - DNA, 27 bp, Artificial Sequence
  Synthetic oligonucleotide
gtcgcaagccagctccgtgctaatatc

SEQ ID NO: 9132 - DNA, 27 bp, Artificial Sequence
  Synthetic oligonucleotide
tcgcaagccagctccgtgctaatatct

SEQ ID NO: 9133 - DNA, 27 bp, Artificial Sequence
  Synthetic oligonucleotide
cgcaagccagctccgtgctaatatctc

SEQ ID NO: 9134 - DNA, 27 bp, Artificial Sequence
  Synthetic oligonucleotide
gcaagccagctccgtgctaatatctct

SEQ ID NO: 9135 - DNA, 27 bp, Artificial Sequence
  Synthetic oligonucleotide
caagccagctccgtgctaatatctctc

SEQ ID NO: 9136 - DNA, 27 bp, Artificial Sequence
  Synthetic oligonucleotide
cacatgaagaccctgttaccagtaagc

SEQ ID NO: 9137 - DNA, 27 bp, Artificial Sequence
  Synthetic oligonucleotide
acatgaagaccctgttaccagtaagca

SEQ ID NO: 9138 - DNA, 27 bp, Artificial Sequence
  Synthetic oligonucleotide
catgaagaccctgttaccagtaagcaa

SEQ ID NO: 9139 - DNA, 27 bp, Artificial Sequence
  Synthetic oligonucleotide
tgaagaccctgttaccagtaagcaagc

SEQ ID NO: 9140 - DNA, 27 bp, Artificial Sequence
  Synthetic oligonucleotide
gaagaccctgttaccagtaagcaagcc

SEQ ID NO: 9141 - DNA, 27 bp, Artificial Sequence
  Synthetic oligonucleotide
aagaccctgttaccagtaagcaagcca

SEQ ID NO: 9142 - DNA, 27 bp, Artificial Sequence
  Synthetic oligonucleotide
agaccctgttaccagtaagcaagccag

SEQ ID NO: 9143 - DNA, 27 bp, Artificial Sequence
  Synthetic oligonucleotide
gaccctgttaccagtaagcaagccaga

SEQ ID NO: 9144 - DNA, 27 bp, Artificial Sequence
  Synthetic oligonucleotide
accctgttaccagtaagcaagccagaa

SEQ ID NO: 9145 - DNA, 27 bp, Artificial Sequence
  Synthetic oligonucleotide
ccctgttaccagtaagcaagccagaaa

SEQ ID NO: 9146 - DNA, 27 bp, Artificial Sequence
  Synthetic oligonucleotide
cctgttaccagtaagcaagccagaaat

SEQ ID NO: 9147 - DNA, 27 bp, Artificial Sequence
  Synthetic oligonucleotide
ctgttaccagtaagcaagccagaaatt

SEQ ID NO: 9148 - DNA, 27 bp, Artificial Sequence
  Synthetic oligonucleotide
tgttaccagtaagcaagccagaaattc

SEQ ID NO: 9149 - DNA, 27 bp, Artificial Sequence
  Synthetic oligonucleotide
gttaccagtaagcaagccagaaattcg

SEQ ID NO: 9150 - DNA, 27 bp, Artificial Sequence
  Synthetic oligonucleotide
ttaccagtaagcaagccagaaattcgg

SEQ ID NO: 9151 - DNA, 27 bp, Artificial Sequence
  Synthetic oligonucleotide
taccagtaagcaagccagaaattcgga

SEQ ID NO: 9152 - DNA, 27 bp, Artificial Sequence
  Synthetic oligonucleotide
accagtaagcaagccagaaattcggag

SEQ ID NO: 9153 - DNA, 27 bp, Artificial Sequence
  Synthetic oligonucleotide
ccagtaagcaagccagaaattcggagt

SEQ ID NO: 9154 - DNA, 27 bp, Artificial Sequence
  Synthetic oligonucleotide
cagtaagcaagccagaaattcggagtt

SEQ ID NO: 9155 - DNA, 27 bp, Artificial Sequence
  Synthetic oligonucleotide
agtaagcaagccagaaattcggagtta

SEQ ID NO: 9156 - DNA, 27 bp, Artificial Sequence
  Synthetic oligonucleotide
gtaagcaagccagaaattcggagttat

SEQ ID NO: 9157 - DNA, 27 bp, Artificial Sequence
  Synthetic oligonucleotide
taagcaagccagaaattcggagttatt

SEQ ID NO: 9158 - DNA, 27 bp, Artificial Sequence
  Synthetic oligonucleotide
aagcaagccagaaattcggagttattt

SEQ ID NO: 9159 - DNA, 27 bp, Artificial Sequence
  Synthetic oligonucleotide
gcaagccagaaattcggagttattttc

SEQ ID NO: 9160 - DNA, 27 bp, Artificial Sequence
  Synthetic oligonucleotide
caagccagaaattcggagttattttcc

SEQ ID NO: 9161 - DNA, 27 bp, Artificial Sequence
  Synthetic oligonucleotide
aagccagaaattcggagttattttcca

SEQ ID NO: 9162 - DNA, 27 bp, Artificial Sequence
  Synthetic oligonucleotide
agccagaaattcggagttattttccag

SEQ ID NO: 9163 - DNA, 27 bp, Artificial Sequence
  Synthetic oligonucleotide
gccagaaattcggagttattttccaga

SEQ ID NO: 9164 - DNA, 27 bp, Artificial Sequence
  Synthetic oligonucleotide
ccagaaattcggagttattttccagaa

SEQ ID NO: 9165 - DNA, 27 bp, Artificial Sequence
  Synthetic oligonucleotide
cagaaattcggagttattttccagaaa

SEQ ID NO: 9166 - DNA, 27 bp, Artificial Sequence
  Synthetic oligonucleotide
agaaattcggagttattttccagaaag

SEQ ID NO: 9167 - DNA, 27 bp, Artificial Sequence
  Synthetic oligonucleotide
gaaattcggagttattttccagaaagc

SEQ ID NO: 9168 - DNA, 27 bp, Artificial Sequence
  Synthetic oligonucleotide
aaattcggagttattttccagaaagct

SEQ ID NO: 9169 - DNA, 27 bp, Artificial Sequence
  Synthetic oligonucleotide
aattcggagttattttccagaaagctg

SEQ ID NO: 9170 - DNA, 27 bp, Artificial Sequence
  Synthetic oligonucleotide
attcggagttattttccagaaagctgg

SEQ ID NO: 9171 - DNA, 27 bp, Artificial Sequence
  Synthetic oligonucleotide
ttcggagttattttccagaaagctggt

SEQ ID NO: 9172 - DNA, 27 bp, Artificial Sequence
  Synthetic oligonucleotide
tcggagttattttccagaaagctggtt

SEQ ID NO: 9173 - DNA, 27 bp, Artificial Sequence
  Synthetic oligonucleotide
cggagttattttccagaaagctggttg

SEQ ID NO: 9174 - DNA, 27 bp, Artificial Sequence
  Synthetic oligonucleotide
ggagttattttccagaaagctggttgt

SEQ ID NO: 9175 - DNA, 27 bp, Artificial Sequence
  Synthetic oligonucleotide
gagttattttccagaaagctggttgtg

SEQ ID NO: 9176 - DNA, 27 bp, Artificial Sequence
  Synthetic oligonucleotide
agttattttccagaaagctggttgtgg

SEQ ID NO: 9177 - DNA, 27 bp, Artificial Sequence
  Synthetic oligonucleotide
gttattttccagaaagctggttgtggg

SEQ ID NO: 9178 - DNA, 27 bp, Artificial Sequence
  Synthetic oligonucleotide
ttattttccagaaagctggttgtggga

SEQ ID NO: 9179 - DNA, 27 bp, Artificial Sequence
  Synthetic oligonucleotide
tgtgggaagttcatcttgttcccagaa

SEQ ID NO: 9180 - DNA, 27 bp, Artificial Sequence
  Synthetic oligonucleotide
gtgggaagttcatcttgttcccagaag

SEQ ID NO: 9181 - DNA, 27 bp, Artificial Sequence
  Synthetic oligonucleotide
tgggaagttcatcttgttcccagaaga

SEQ ID NO: 9182 - DNA, 27 bp, Artificial Sequence
  Synthetic oligonucleotide
gggaagttcatcttgttcccagaagaa

SEQ ID NO: 9183 - DNA, 27 bp, Artificial Sequence
  Synthetic oligonucleotide
ggaagttcatcttgttcccagaagaaa

SEQ ID NO: 9184 - DNA, 27 bp, Artificial Sequence
  Synthetic oligonucleotide
gaagttcatcttgttcccagaagaaaa

SEQ ID NO: 9185 - DNA, 27 bp, Artificial Sequence
  Synthetic oligonucleotide
aagttcatcttgttcccagaagaaaac

SEQ ID NO: 9186 - DNA, 27 bp, Artificial Sequence
  Synthetic oligonucleotide
agttcatcttgttcccagaagaaaaca

SEQ ID NO: 9187 - DNA, 27 bp, Artificial Sequence
  Synthetic oligonucleotide
gttcatcttgttcccagaagaaaacag

SEQ ID NO: 9188 - DNA, 27 bp, Artificial Sequence
  Synthetic oligonucleotide
ttcatcttgttcccagaagaaaacagt

SEQ ID NO: 9189 - DNA, 27 bp, Artificial Sequence
  Synthetic oligonucleotide
tcatcttgttcccagaagaaaacagtt

SEQ ID NO: 9190 - DNA, 27 bp, Artificial Sequence
  Synthetic oligonucleotide
catcttgttcccagaagaaaacagttg

SEQ ID NO: 9191 - DNA, 27 bp, Artificial Sequence
  Synthetic oligonucleotide
atcttgttcccagaagaaaacagttgc

SEQ ID NO: 9192 - DNA, 27 bp, Artificial Sequence
  Synthetic oligonucleotide
tcttgttcccagaagaaaacagttgca

SEQ ID NO: 9193 - DNA, 27 bp, Artificial Sequence
  Synthetic oligonucleotide
cttgttcccagaagaaaacagttgcag

SEQ ID NO: 9194 - DNA, 27 bp, Artificial Sequence
  Synthetic oligonucleotide
ttgttcccagaagaaaacagttgcagt

SEQ ID NO: 9195 - DNA, 27 bp, Artificial Sequence
  Synthetic oligonucleotide
tgttcccagaagaaaacagttgcagtt

SEQ ID NO: 9196 - DNA, 27 bp, Artificial Sequence
  Synthetic oligonucleotide
gttcccagaagaaaacagttgcagttt

SEQ ID NO: 9197 - DNA, 27 bp, Artificial Sequence
  Synthetic oligonucleotide
ttcccagaagaaaacagttgcagtttg

SEQ ID NO: 9198 - DNA, 27 bp, Artificial Sequence
  Synthetic oligonucleotide
tcccagaagaaaacagttgcagtttgc

SEQ ID NO: 9199 - DNA, 27 bp, Artificial Sequence
  Synthetic oligonucleotide
cccagaagaaaacagttgcagtttgcc

SEQ ID NO: 9200 - DNA, 27 bp, Artificial Sequence
  Synthetic oligonucleotide
ccagaagaaaacagttgcagtttgccc

SEQ ID NO: 9201 - DNA, 27 bp, Artificial Sequence
  Synthetic oligonucleotide
cagaagaaaacagttgcagtttgccct

SEQ ID NO: 9202 - DNA, 27 bp, Artificial Sequence
  Synthetic oligonucleotide
agaagaaaacagttgcagtttgcccta

SEQ ID NO: 9203 - DNA, 27 bp, Artificial Sequence
  Synthetic oligonucleotide
gaagaaaacagttgcagtttgccctac

SEQ ID NO: 9204 - DNA, 27 bp, Artificial Sequence
  Synthetic oligonucleotide
aagaaaacagttgcagtttgccctacc

SEQ ID NO: 9205 - DNA, 27 bp, Artificial Sequence
  Synthetic oligonucleotide
agaaaacagttgcagtttgccctacct

SEQ ID NO: 9206 - DNA, 27 bp, Artificial Sequence
  Synthetic oligonucleotide
gaaaacagttgcagtttgccctacctg

SEQ ID NO: 9207 - DNA, 27 bp, Artificial Sequence
  Synthetic oligonucleotide
aaaacagttgcagtttgccctacctga

SEQ ID NO: 9208 - DNA, 27 bp, Artificial Sequence
  Synthetic oligonucleotide
aaacagttgcagtttgccctacctgat

SEQ ID NO: 9209 - DNA, 27 bp, Artificial Sequence
  Synthetic oligonucleotide
aacagttgcagtttgccctacctgatt

SEQ ID NO: 9210 - DNA, 27 bp, Artificial Sequence
  Synthetic oligonucleotide
acagttgcagtttgccctacctgattc

SEQ ID NO: 9211 - DNA, 27 bp, Artificial Sequence
  Synthetic oligonucleotide
cagttgcagtttgccctacctgattct

SEQ ID NO: 9212 - DNA, 27 bp, Artificial Sequence
  Synthetic oligonucleotide
agttgcagtttgccctacctgattctc

SEQ ID NO: 9213 - DNA, 27 bp, Artificial Sequence
  Synthetic oligonucleotide
gttgcagtttgccctacctgattctct

SEQ ID NO: 9214 - DNA, 27 bp, Artificial Sequence
  Synthetic oligonucleotide
ttgcagtttgccctacctgattctcta

SEQ ID NO: 9215 - DNA, 27 bp, Artificial Sequence
  Synthetic oligonucleotide
tgcagtttgccctacctgattctctaa

SEQ ID NO: 9216 - DNA, 27 bp, Artificial Sequence
  Synthetic oligonucleotide
gcagtttgccctacctgattctctaac

SEQ ID NO: 9217 - DNA, 27 bp, Artificial Sequence
  Synthetic oligonucleotide
cagtttgccctacctgattctctaacc

SEQ ID NO: 9218 - DNA, 27 bp, Artificial Sequence
  Synthetic oligonucleotide
aaggcaaaggtgttcaaagatgtcttc

SEQ ID NO: 9219 - DNA, 27 bp, Artificial Sequence
  Synthetic oligonucleotide
aggcaaaggtgttcaaagatgtcttcc

SEQ ID NO: 9220 - DNA, 27 bp, Artificial Sequence
  Synthetic oligonucleotide
ggcaaaggtgttcaaagatgtcttcct

SEQ ID NO: 9221 - DNA, 27 bp, Artificial Sequence
  Synthetic oligonucleotide
gcaaaggtgttcaaagatgtcttcctg

SEQ ID NO: 9222 - DNA, 27 bp, Artificial Sequence
  Synthetic oligonucleotide
caaaggtgttcaaagatgtcttcctgg

SEQ ID NO: 9223 - DNA, 27 bp, Artificial Sequence
  Synthetic oligonucleotide
aaaggtgttcaaagatgtcttcctgga

SEQ ID NO: 9224 - DNA, 27 bp, Artificial Sequence
  Synthetic oligonucleotide
aaggtgttcaaagatgtcttcctggaa

SEQ ID NO: 9225 - DNA, 27 bp, Artificial Sequence
  Synthetic oligonucleotide
aggtgttcaaagatgtcttcctggaaa

SEQ ID NO: 9226 - DNA, 27 bp, Artificial Sequence
  Synthetic oligonucleotide
ggtgttcaaagatgtcttcctggaaat

SEQ ID NO: 9227 - DNA, 27 bp, Artificial Sequence
  Synthetic oligonucleotide
gtgttcaaagatgtcttcctggaaatg

SEQ ID NO: 9228 - DNA, 27 bp, Artificial Sequence
  Synthetic oligonucleotide
tgttcaaagatgtcttcctggaaatga

SEQ ID NO: 9229 - DNA, 27 bp, Artificial Sequence
  Synthetic oligonucleotide
gttcaaagatgtcttcctggaaatgaa

SEQ ID NO: 9230 - DNA, 27 bp, Artificial Sequence
  Synthetic oligonucleotide
ttcaaagatgtcttcctggaaatgaat

SEQ ID NO: 9231 - DNA, 27 bp, Artificial Sequence
  Synthetic oligonucleotide
tcaaagatgtcttcctggaaatgaata

SEQ ID NO: 9232 - DNA, 27 bp, Artificial Sequence
  Synthetic oligonucleotide
caaagatgtcttcctggaaatgaatat

SEQ ID NO: 9233 - DNA, 27 bp, Artificial Sequence
  Synthetic oligonucleotide
aaagatgtcttcctggaaatgaatata

SEQ ID NO: 9234 - DNA, 27 bp, Artificial Sequence
  Synthetic oligonucleotide
agatgtcttcctggaaatgaatatacc

SEQ ID NO: 9235 - DNA, 27 bp, Artificial Sequence
  Synthetic oligonucleotide
gatgtcttcctggaaatgaatatacca

SEQ ID NO: 9236 - DNA, 27 bp, Artificial Sequence
  Synthetic oligonucleotide
atgtcttcctggaaatgaatataccat

SEQ ID NO: 9237 - DNA, 27 bp, Artificial Sequence
  Synthetic oligonucleotide
tgtcttcctggaaatgaatataccata

SEQ ID NO: 9238 - DNA, 27 bp, Artificial Sequence
  Synthetic oligonucleotide
gtcttcctggaaatgaatataccatat

SEQ ID NO: 9239 - DNA, 27 bp, Artificial Sequence
  Synthetic oligonucleotide
tcttcctggaaatgaatataccatatt

SEQ ID NO: 9240 - DNA, 27 bp, Artificial Sequence
  Synthetic oligonucleotide
cttcctggaaatgaatataccatattc

SEQ ID NO: 9241 - DNA, 27 bp, Artificial Sequence
  Synthetic oligonucleotide
ttcctggaaatgaatataccatattct

SEQ ID NO: 9242 - DNA, 27 bp, Artificial Sequence
  Synthetic oligonucleotide
aatataccatattctgttgtacgagga

SEQ ID NO: 9243 - DNA, 27 bp, Artificial Sequence
  Synthetic oligonucleotide
atataccatattctgttgtacgaggag

SEQ ID NO: 9244 - DNA, 27 bp, Artificial Sequence
  Synthetic oligonucleotide
tataccatattctgttgtacgaggaga

SEQ ID NO: 9245 - DNA, 27 bp, Artificial Sequence
  Synthetic oligonucleotide
ataccatattctgttgtacgaggagaa

SEQ ID NO: 9246 - DNA, 27 bp, Artificial Sequence
  Synthetic oligonucleotide
taccatattctgttgtacgaggagaac

SEQ ID NO: 9247 - DNA, 27 bp, Artificial Sequence
  Synthetic oligonucleotide
accatattctgttgtacgaggagaaca

SEQ ID NO: 9248 - DNA, 27 bp, Artificial Sequence
  Synthetic oligonucleotide
ccatattctgttgtacgaggagaacag

SEQ ID NO: 9249 - DNA, 27 bp, Artificial Sequence
  Synthetic oligonucleotide
catattctgttgtacgaggagaacaga

SEQ ID NO: 9250 - DNA, 27 bp, Artificial Sequence
  Synthetic oligonucleotide
atattctgttgtacgaggagaacagat

SEQ ID NO: 9251 - DNA, 27 bp, Artificial Sequence
  Synthetic oligonucleotide
tattctgttgtacgaggagaacagatc

SEQ ID NO: 9252 - DNA, 27 bp, Artificial Sequence
  Synthetic oligonucleotide
attctgttgtacgaggagaacagatcc

SEQ ID NO: 9253 - DNA, 27 bp, Artificial Sequence
  Synthetic oligonucleotide
ttctgttgtacgaggagaacagatcca

SEQ ID NO: 9254 - DNA, 27 bp, Artificial Sequence
  Synthetic oligonucleotide
tctgttgtacgaggagaacagatccaa

SEQ ID NO: 9255 - DNA, 27 bp, Artificial Sequence
  Synthetic oligonucleotide
aggaactgtttacaactataggacttc

SEQ ID NO: 9256 - DNA, 27 bp, Artificial Sequence
  Synthetic oligonucleotide
ggaactgtttacaactataggacttct

SEQ ID NO: 9257 - DNA, 27 bp, Artificial Sequence
  Synthetic oligonucleotide
gaactgtttacaactataggacttctg

SEQ ID NO: 9258 - DNA, 27 bp, Artificial Sequence
  Synthetic oligonucleotide
aactgtttacaactataggacttctgg

SEQ ID NO: 9259 - DNA, 27 bp, Artificial Sequence
  Synthetic oligonucleotide
actgtttacaactataggacttctggg

SEQ ID NO: 9260 - DNA, 27 bp, Artificial Sequence
  Synthetic oligonucleotide
ctgtttacaactataggacttctggga

SEQ ID NO: 9261 - DNA, 27 bp, Artificial Sequence
  Synthetic oligonucleotide
tgtttacaactataggacttctgggat

SEQ ID NO: 9262 - DNA, 27 bp, Artificial Sequence
  Synthetic oligonucleotide
gtttacaactataggacttctgggatg

SEQ ID NO: 9263 - DNA, 27 bp, Artificial Sequence
  Synthetic oligonucleotide
tttacaactataggacttctgggatgc

SEQ ID NO: 9264 - DNA, 27 bp, Artificial Sequence
  Synthetic oligonucleotide
ttacaactataggacttctgggatgca

SEQ ID NO: 9265 - DNA, 27 bp, Artificial Sequence
  Synthetic oligonucleotide
tacaactataggacttctgggatgcag

SEQ ID NO: 9266 - DNA, 27 bp, Artificial Sequence
  Synthetic oligonucleotide
acaactataggacttctgggatgcagt

SEQ ID NO: 9267 - DNA, 27 bp, Artificial Sequence
  Synthetic oligonucleotide
caactataggacttctgggatgcagtt

SEQ ID NO: 9268 - DNA, 27 bp, Artificial Sequence
  Synthetic oligonucleotide
aactataggacttctgggatgcagttc

SEQ ID NO: 9269 - DNA, 27 bp, Artificial Sequence
  Synthetic oligonucleotide
actataggacttctgggatgcagttct

SEQ ID NO: 9270 - DNA, 27 bp, Artificial Sequence
  Synthetic oligonucleotide
ctataggacttctgggatgcagttctg

SEQ ID NO: 9271 - DNA, 27 bp, Artificial Sequence
  Synthetic oligonucleotide
tataggacttctgggatgcagttctgt

SEQ ID NO: 9272 - DNA, 27 bp, Artificial Sequence
  Synthetic oligonucleotide
ataggacttctgggatgcagttctgtg

SEQ ID NO: 9273 - DNA, 27 bp, Artificial Sequence
  Synthetic oligonucleotide
aaaatgtctgctgtggagggaatctgc

SEQ ID NO: 9274 - DNA, 27 bp, Artificial Sequence
  Synthetic oligonucleotide
aaatgtctgctgtggagggaatctgca

SEQ ID NO: 9275 - DNA, 27 bp, Artificial Sequence
  Synthetic oligonucleotide
aatgtctgctgtggagggaatctgcac

SEQ ID NO: 9276 - DNA, 27 bp, Artificial Sequence
  Synthetic oligonucleotide
atgtctgctgtggagggaatctgcact

SEQ ID NO: 9277 - DNA, 27 bp, Artificial Sequence
  Synthetic oligonucleotide
tgtctgctgtggagggaatctgcactt

SEQ ID NO: 9278 - DNA, 27 bp, Artificial Sequence
  Synthetic oligonucleotide
gtctgctgtggagggaatctgcacttc

SEQ ID NO: 9279 - DNA, 27 bp, Artificial Sequence
  Synthetic oligonucleotide
tctgctgtggagggaatctgcacttcg

SEQ ID NO: 9280 - DNA, 27 bp, Artificial Sequence
  Synthetic oligonucleotide
ctgctgtggagggaatctgcacttcgg

SEQ ID NO: 9281 - DNA, 27 bp, Artificial Sequence
  Synthetic oligonucleotide
tgctgtggagggaatctgcacttcgga

SEQ ID NO: 9282 - DNA, 27 bp, Artificial Sequence
  Synthetic oligonucleotide
gctgtggagggaatctgcacttcggaa

SEQ ID NO: 9283 - DNA, 27 bp, Artificial Sequence
  Synthetic oligonucleotide
ctgtggagggaatctgcacttcggaaa

SEQ ID NO: 9284 - DNA, 27 bp, Artificial Sequence
  Synthetic oligonucleotide
tgtggagggaatctgcacttcggaaag

SEQ ID NO: 9285 - DNA, 27 bp, Artificial Sequence
  Synthetic oligonucleotide
cggaaagcccagtcattgatcatcagg

SEQ ID NO: 9286 - DNA, 27 bp, Artificial Sequence
  Synthetic oligonucleotide
ggaaagcccagtcattgatcatcaggg

SEQ ID NO: 9287 - DNA, 27 bp, Artificial Sequence
  Synthetic oligonucleotide
gaaagcccagtcattgatcatcagggc

SEQ ID NO: 9288 - DNA, 27 bp, Artificial Sequence
  Synthetic oligonucleotide
aaagcccagtcattgatcatcagggca

SEQ ID NO: 9289 - DNA, 27 bp, Artificial Sequence
  Synthetic oligonucleotide
aagcccagtcattgatcatcagggcac

SEQ ID NO: 9290 - DNA, 27 bp, Artificial Sequence
  Synthetic oligonucleotide
agcccagtcattgatcatcagggcaca

SEQ ID NO: 9291 - DNA, 27 bp, Artificial Sequence
  Synthetic oligonucleotide
gcccagtcattgatcatcagggcacaa

SEQ ID NO: 9292 - DNA, 27 bp, Artificial Sequence
  Synthetic oligonucleotide
cccagtcattgatcatcagggcacaaa

SEQ ID NO: 9293 - DNA, 27 bp, Artificial Sequence
  Synthetic oligonucleotide
ccagtcattgatcatcagggcacaaag

SEQ ID NO: 9294 - DNA, 27 bp, Artificial Sequence
  Synthetic oligonucleotide
cagtcattgatcatcagggcacaaagt

SEQ ID NO: 9295 - DNA, 27 bp, Artificial Sequence
  Synthetic oligonucleotide
agtcattgatcatcagggcacaaagtc

SEQ ID NO: 9296 - DNA, 27 bp, Artificial Sequence
  Synthetic oligonucleotide
gtcattgatcatcagggcacaaagtcc

SEQ ID NO: 9297 - DNA, 27 bp, Artificial Sequence
  Synthetic oligonucleotide
tcattgatcatcagggcacaaagtcct

SEQ ID NO: 9298 - DNA, 27 bp, Artificial Sequence
  Synthetic oligonucleotide
cattgatcatcagggcacaaagtcctc

SEQ ID NO: 9299 - DNA, 27 bp, Artificial Sequence
  Synthetic oligonucleotide
attgatcatcagggcacaaagtcctcc

SEQ ID NO: 9300 - DNA, 27 bp, Artificial Sequence
  Synthetic oligonucleotide
ttgatcatcagggcacaaagtcctcca

SEQ ID NO: 9301 - DNA, 27 bp, Artificial Sequence
  Synthetic oligonucleotide
tgatcatcagggcacaaagtcctccaa

SEQ ID NO: 9302 - DNA, 27 bp, Artificial Sequence
  Synthetic oligonucleotide
gatcatcagggcacaaagtcctccaaa

SEQ ID NO: 9303 - DNA, 27 bp, Artificial Sequence
  Synthetic oligonucleotide
atcatcagggcacaaagtcctccaaat

SEQ ID NO: 9304 - DNA, 27 bp, Artificial Sequence
  Synthetic oligonucleotide
tcatcagggcacaaagtcctccaaatg

SEQ ID NO: 9305 - DNA, 27 bp, Artificial Sequence
  Synthetic oligonucleotide
catcagggcacaaagtcctccaaatgt

SEQ ID NO: 9306 - DNA, 27 bp, Artificial Sequence
  Synthetic oligonucleotide
atcagggcacaaagtcctccaaatgtg

SEQ ID NO: 9307 - DNA, 27 bp, Artificial Sequence
  Synthetic oligonucleotide
ccagaaagtagagggctcctccagtca

SEQ ID NO: 9308 - DNA, 27 bp, Artificial Sequence
  Synthetic oligonucleotide
tcactgtgcttcctctggaaattggcc

SEQ ID NO: 9309 - DNA, 27 bp, Artificial Sequence
  Synthetic oligonucleotide
cactgtgcttcctctggaaattggcct

SEQ ID NO: 9310 - DNA, 27 bp, Artificial Sequence
  Synthetic oligonucleotide
actgtgcttcctctggaaattggcctt

SEQ ID NO: 9311 - DNA, 27 bp, Artificial Sequence
  Synthetic oligonucleotide
ctgtgcttcctctggaaattggccttc

SEQ ID NO: 9312 - DNA, 27 bp, Artificial Sequence
  Synthetic oligonucleotide
tggtttggaaaagaaatcttagtaaaa

SEQ ID NO: 9313 - DNA, 27 bp, Artificial Sequence
  Synthetic oligonucleotide
ggtttggaaaagaaatcttagtaaaaa

SEQ ID NO: 9314 - DNA, 27 bp, Artificial Sequence
  Synthetic oligonucleotide
gtttggaaaagaaatcttagtaaaaac

SEQ ID NO: 9315 - DNA, 27 bp, Artificial Sequence
  Synthetic oligonucleotide
tttggaaaagaaatcttagtaaaaaca

SEQ ID NO: 9316 - DNA, 27 bp, Artificial Sequence
  Synthetic oligonucleotide
ttggaaaagaaatcttagtaaaaacat

SEQ ID NO: 9317 - DNA, 27 bp, Artificial Sequence
  Synthetic oligonucleotide
tggaaaagaaatcttagtaaaaacatt

SEQ ID NO: 9318 - DNA, 27 bp, Artificial Sequence
  Synthetic oligonucleotide
ggaaaagaaatcttagtaaaaacatta

SEQ ID NO: 9319 - DNA, 27 bp, Artificial Sequence
  Synthetic oligonucleotide
cattacgagtggtgccagaaggtgtca

SEQ ID NO: 9320 - DNA, 27 bp, Artificial Sequence
  Synthetic oligonucleotide
attacgagtggtgccagaaggtgtcaa

SEQ ID NO: 9321 - DNA, 27 bp, Artificial Sequence
  Synthetic oligonucleotide
ttacgagtggtgccagaaggtgtcaaa

SEQ ID NO: 9322 - DNA, 27 bp, Artificial Sequence
  Synthetic oligonucleotide
tacgagtggtgccagaaggtgtcaaaa

SEQ ID NO: 9323 - DNA, 27 bp, Artificial Sequence
  Synthetic oligonucleotide
acgagtggtgccagaaggtgtcaaaag

SEQ ID NO: 9324 - DNA, 27 bp, Artificial Sequence
  Synthetic oligonucleotide
cgagtggtgccagaaggtgtcaaaagg

SEQ ID NO: 9325 - DNA, 27 bp, Artificial Sequence
  Synthetic oligonucleotide
gagtggtgccagaaggtgtcaaaaggg

SEQ ID NO: 9326 - DNA, 27 bp, Artificial Sequence
  Synthetic oligonucleotide
agtggtgccagaaggtgtcaaaaggga

SEQ ID NO: 9327 - DNA, 27 bp, Artificial Sequence
  Synthetic oligonucleotide
gtggtgccagaaggtgtcaaaagggaa

SEQ ID NO: 9328 - DNA, 27 bp, Artificial Sequence
  Synthetic oligonucleotide
tggtgccagaaggtgtcaaaagggaaa

SEQ ID NO: 9329 - DNA, 27 bp, Artificial Sequence
  Synthetic oligonucleotide
ggtgccagaaggtgtcaaaagggaaag

SEQ ID NO: 9330 - DNA, 27 bp, Artificial Sequence
  Synthetic oligonucleotide
gtgccagaaggtgtcaaaagggaaagc

SEQ ID NO: 9331 - DNA, 27 bp, Artificial Sequence
  Synthetic oligonucleotide
tgccagaaggtgtcaaaagggaaagct

SEQ ID NO: 9332 - DNA, 27 bp, Artificial Sequence
  Synthetic oligonucleotide
gccagaaggtgtcaaaagggaaagcta

SEQ ID NO: 9333 - DNA, 27 bp, Artificial Sequence
  Synthetic oligonucleotide
ccagaaggtgtcaaaagggaaagctat

SEQ ID NO: 9334 - DNA, 27 bp, Artificial Sequence
  Synthetic oligonucleotide
cagaaggtgtcaaaagggaaagctatt

SEQ ID NO: 9335 - DNA, 27 bp, Artificial Sequence
  Synthetic oligonucleotide
agaaggtgtcaaaagggaaagctattc

SEQ ID NO: 9336 - DNA, 27 bp, Artificial Sequence
  Synthetic oligonucleotide
gaaggtgtcaaaagggaaagctattct

SEQ ID NO: 9337 - DNA, 27 bp, Artificial Sequence
  Synthetic oligonucleotide
aaggtgtcaaaagggaaagctattctg

SEQ ID NO: 9338 - DNA, 27 bp, Artificial Sequence
  Synthetic oligonucleotide
aggtgtcaaaagggaaagctattctgg

SEQ ID NO: 9339 - DNA, 27 bp, Artificial Sequence
  Synthetic oligonucleotide
ggtgtcaaaagggaaagctattctggt

SEQ ID NO: 9340 - DNA, 27 bp, Artificial Sequence
  Synthetic oligonucleotide
gtgtcaaaagggaaagctattctggtg

SEQ ID NO: 9341 - DNA, 27 bp, Artificial Sequence
  Synthetic oligonucleotide
tgtcaaaagggaaagctattctggtgt

SEQ ID NO: 9342 - DNA, 27 bp, Artificial Sequence
  Synthetic oligonucleotide
gtcaaaagggaaagctattctggtgtt

SEQ ID NO: 9343 - DNA, 27 bp, Artificial Sequence
  Synthetic oligonucleotide
tcaaaagggaaagctattctggtgtta

SEQ ID NO: 9344 - DNA, 27 bp, Artificial Sequence
  Synthetic oligonucleotide
caaaagggaaagctattctggtgttac

SEQ ID NO: 9345 - DNA, 27 bp, Artificial Sequence
  Synthetic oligonucleotide
aaaagggaaagctattctggtgttact

SEQ ID NO: 9346 - DNA, 27 bp, Artificial Sequence
  Synthetic oligonucleotide
tgttactttggatcctaggggtattta

SEQ ID NO: 9347 - DNA, 27 bp, Artificial Sequence
  Synthetic oligonucleotide
gttactttggatcctaggggtatttat

SEQ ID NO: 9348 - DNA, 27 bp, Artificial Sequence
  Synthetic oligonucleotide
ttactttggatcctaggggtatttatg

SEQ ID NO: 9349 - DNA, 27 bp, Artificial Sequence
  Synthetic oligonucleotide
tactttggatcctaggggtatttatgg

SEQ ID NO: 9350 - DNA, 27 bp, Artificial Sequence
  Synthetic oligonucleotide
actttggatcctaggggtatttatggt

SEQ ID NO: 9351 - DNA, 27 bp, Artificial Sequence
  Synthetic oligonucleotide
ctttggatcctaggggtatttatggta

SEQ ID NO: 9352 - DNA, 27 bp, Artificial Sequence
  Synthetic oligonucleotide
tttggatcctaggggtatttatggtac

SEQ ID NO: 9353 - DNA, 27 bp, Artificial Sequence
  Synthetic oligonucleotide
ttggatcctaggggtatttatggtacc

SEQ ID NO: 9354 - DNA, 27 bp, Artificial Sequence
  Synthetic oligonucleotide
tggatcctaggggtatttatggtacca

SEQ ID NO: 9355 - DNA, 27 bp, Artificial Sequence
  Synthetic oligonucleotide
gacgaaaggagttcccatacaggatac

SEQ ID NO: 9356 - DNA, 27 bp, Artificial Sequence
  Synthetic oligonucleotide
acgaaaggagttcccatacaggatacc

SEQ ID NO: 9357 - DNA, 27 bp, Artificial Sequence
  Synthetic oligonucleotide
cgaaaggagttcccatacaggataccc

SEQ ID NO: 9358 - DNA, 27 bp, Artificial Sequence
  Synthetic oligonucleotide
gaaaggagttcccatacaggataccct

SEQ ID NO: 9359 - DNA, 27 bp, Artificial Sequence
  Synthetic oligonucleotide
aaaggagttcccatacaggataccctt

SEQ ID NO: 9360 - DNA, 27 bp, Artificial Sequence
  Synthetic oligonucleotide
aaggagttcccatacaggataccctta

SEQ ID NO: 9361 - DNA, 27 bp, Artificial Sequence
  Synthetic oligonucleotide
aggagttcccatacaggatacccttag

SEQ ID NO: 9362 - DNA, 27 bp, Artificial Sequence
  Synthetic oligonucleotide
ggagttcccatacaggatacccttaga

SEQ ID NO: 9363 - DNA, 27 bp, Artificial Sequence
  Synthetic oligonucleotide
ccttagatttggtccccaaaacagaaa

SEQ ID NO: 9364 - DNA, 27 bp, Artificial Sequence
  Synthetic oligonucleotide
cttagatttggtccccaaaacagaaat

SEQ ID NO: 9365 - DNA, 27 bp, Artificial Sequence
  Synthetic oligonucleotide
ttagatttggtccccaaaacagaaatc

SEQ ID NO: 9366 - DNA, 27 bp, Artificial Sequence
  Synthetic oligonucleotide
tagatttggtccccaaaacagaaatca

SEQ ID NO: 9367 - DNA, 27 bp, Artificial Sequence
  Synthetic oligonucleotide
agatttggtccccaaaacagaaatcaa

SEQ ID NO: 9368 - DNA, 27 bp, Artificial Sequence
  Synthetic oligonucleotide
gatttggtccccaaaacagaaatcaaa

SEQ ID NO: 9369 - DNA, 27 bp, Artificial Sequence
  Synthetic oligonucleotide
atttggtccccaaaacagaaatcaaaa

SEQ ID NO: 9370 - DNA, 27 bp, Artificial Sequence
  Synthetic oligonucleotide
tttggtccccaaaacagaaatcaaaag

SEQ ID NO: 9371 - DNA, 27 bp, Artificial Sequence
  Synthetic oligonucleotide
ttggtccccaaaacagaaatcaaaagg

SEQ ID NO: 9372 - DNA, 27 bp, Artificial Sequence
  Synthetic oligonucleotide
tggtccccaaaacagaaatcaaaagga

SEQ ID NO: 9373 - DNA, 27 bp, Artificial Sequence
  Synthetic oligonucleotide
ggtccccaaaacagaaatcaaaaggat

SEQ ID NO: 9374 - DNA, 27 bp, Artificial Sequence
  Synthetic oligonucleotide
gtccccaaaacagaaatcaaaaggatt

SEQ ID NO: 9375 - DNA, 27 bp, Artificial Sequence
  Synthetic oligonucleotide
tccccaaaacagaaatcaaaaggattt

SEQ ID NO: 9376 - DNA, 27 bp, Artificial Sequence
  Synthetic oligonucleotide
ccccaaaacagaaatcaaaaggatttt

SEQ ID NO: 9377 - DNA, 27 bp, Artificial Sequence
  Synthetic oligonucleotide
cccaaaacagaaatcaaaaggattttg

SEQ ID NO: 9378 - DNA, 27 bp, Artificial Sequence
  Synthetic oligonucleotide
ccaaaacagaaatcaaaaggattttga

SEQ ID NO: 9379 - DNA, 27 bp, Artificial Sequence
  Synthetic oligonucleotide
caaaacagaaatcaaaaggattttgag

SEQ ID NO: 9380 - DNA, 27 bp, Artificial Sequence
  Synthetic oligonucleotide
aaaacagaaatcaaaaggattttgagt

SEQ ID NO: 9381 - DNA, 27 bp, Artificial Sequence
  Synthetic oligonucleotide
aaacagaaatcaaaaggattttgagtg

SEQ ID NO: 9382 - DNA, 27 bp, Artificial Sequence
  Synthetic oligonucleotide
aacagaaatcaaaaggattttgagtgt

SEQ ID NO: 9383 - DNA, 27 bp, Artificial Sequence
  Synthetic oligonucleotide
agaaatcaaaaggattttgagtgtaaa

SEQ ID NO: 9384 - DNA, 27 bp, Artificial Sequence
  Synthetic oligonucleotide
gaaatcaaaaggattttgagtgtaaaa

SEQ ID NO: 9385 - DNA, 27 bp, Artificial Sequence
  Synthetic oligonucleotide
aaatcaaaaggattttgagtgtaaaag

SEQ ID NO: 9386 - DNA, 27 bp, Artificial Sequence
  Synthetic oligonucleotide
aatcaaaaggattttgagtgtaaaagg

SEQ ID NO: 9387 - DNA, 27 bp, Artificial Sequence
  Synthetic oligonucleotide
tcaaaaggattttgagtgtaaaaggac

SEQ ID NO: 9388 - DNA, 27 bp, Artificial Sequence
  Synthetic oligonucleotide
caaaaggattttgagtgtaaaaggact

SEQ ID NO: 9389 - DNA, 27 bp, Artificial Sequence
  Synthetic oligonucleotide
aaaaggattttgagtgtaaaaggactg

SEQ ID NO: 9390 - DNA, 27 bp, Artificial Sequence
  Synthetic oligonucleotide
aaaggattttgagtgtaaaaggactgc

SEQ ID NO: 9391 - DNA, 27 bp, Artificial Sequence
  Synthetic oligonucleotide
aaggattttgagtgtaaaaggactgct

SEQ ID NO: 9392 - DNA, 27 bp, Artificial Sequence
  Synthetic oligonucleotide
aggattttgagtgtaaaaggactgctt

SEQ ID NO: 9393 - DNA, 27 bp, Artificial Sequence
  Synthetic oligonucleotide
ggattttgagtgtaaaaggactgcttg

SEQ ID NO: 9394 - DNA, 27 bp, Artificial Sequence
  Synthetic oligonucleotide
gattttgagtgtaaaaggactgcttgt

SEQ ID NO: 9395 - DNA, 27 bp, Artificial Sequence
  Synthetic oligonucleotide
attttgagtgtaaaaggactgcttgta

SEQ ID NO: 9396 - DNA, 27 bp, Artificial Sequence
  Synthetic oligonucleotide
ttttgagtgtaaaaggactgcttgtag

SEQ ID NO: 9397 - DNA, 27 bp, Artificial Sequence
  Synthetic oligonucleotide
tttgagtgtaaaaggactgcttgtagg

SEQ ID NO: 9398 - DNA, 27 bp, Artificial Sequence
  Synthetic oligonucleotide
ttgagtgtaaaaggactgcttgtaggt

SEQ ID NO: 9399 - DNA, 27 bp, Artificial Sequence
  Synthetic oligonucleotide
tgagtgtaaaaggactgcttgtaggtg

SEQ ID NO: 9400 - DNA, 27 bp, Artificial Sequence
  Synthetic oligonucleotide
gagtgtaaaaggactgcttgtaggtga

SEQ ID NO: 9401 - DNA, 27 bp, Artificial Sequence
  Synthetic oligonucleotide
agtgtaaaaggactgcttgtaggtgag

SEQ ID NO: 9402 - DNA, 27 bp, Artificial Sequence
  Synthetic oligonucleotide
gtgtaaaaggactgcttgtaggtgaga

SEQ ID NO: 9403 - DNA, 27 bp, Artificial Sequence
  Synthetic oligonucleotide
tgtaaaaggactgcttgtaggtgagat

SEQ ID NO: 9404 - DNA, 27 bp, Artificial Sequence
  Synthetic oligonucleotide
gtaaaaggactgcttgtaggtgagatc

SEQ ID NO: 9405 - DNA, 27 bp, Artificial Sequence
  Synthetic oligonucleotide
taaaaggactgcttgtaggtgagatct

SEQ ID NO: 9406 - DNA, 27 bp, Artificial Sequence
  Synthetic oligonucleotide
aaaaggactgcttgtaggtgagatctt

SEQ ID NO: 9407 - DNA, 27 bp, Artificial Sequence
  Synthetic oligonucleotide
aaaggactgcttgtaggtgagatcttg

SEQ ID NO: 9408 - DNA, 27 bp, Artificial Sequence
  Synthetic oligonucleotide
aaggactgcttgtaggtgagatcttgt

SEQ ID NO: 9409 - DNA, 27 bp, Artificial Sequence
  Synthetic oligonucleotide
aggactgcttgtaggtgagatcttgtc

SEQ ID NO: 9410 - DNA, 27 bp, Artificial Sequence
  Synthetic oligonucleotide
ggactgcttgtaggtgagatcttgtct

SEQ ID NO: 9411 - DNA, 27 bp, Artificial Sequence
  Synthetic oligonucleotide
gactgcttgtaggtgagatcttgtctg

SEQ ID NO: 9412 - DNA, 27 bp, Artificial Sequence
  Synthetic oligonucleotide
actgcttgtaggtgagatcttgtctgc

SEQ ID NO: 9413 - DNA, 27 bp, Artificial Sequence
  Synthetic oligonucleotide
ctgcttgtaggtgagatcttgtctgca

SEQ ID NO: 9414 - DNA, 27 bp, Artificial Sequence
  Synthetic oligonucleotide
tgcttgtaggtgagatcttgtctgcag

SEQ ID NO: 9415 - DNA, 27 bp, Artificial Sequence
  Synthetic oligonucleotide
gcttgtaggtgagatcttgtctgcagt

SEQ ID NO: 9416 - DNA, 27 bp, Artificial Sequence
  Synthetic oligonucleotide
cttgtaggtgagatcttgtctgcagtt

SEQ ID NO: 9417 - DNA, 27 bp, Artificial Sequence
  Synthetic oligonucleotide
ttgtaggtgagatcttgtctgcagttc

SEQ ID NO: 9418 - DNA, 27 bp, Artificial Sequence
  Synthetic oligonucleotide
tgtaggtgagatcttgtctgcagttct

SEQ ID NO: 9419 - DNA, 27 bp, Artificial Sequence
  Synthetic oligonucleotide
gtaggtgagatcttgtctgcagttcta

SEQ ID NO: 9420 - DNA, 27 bp, Artificial Sequence
  Synthetic oligonucleotide
taggtgagatcttgtctgcagttctaa

SEQ ID NO: 9421 - DNA, 27 bp, Artificial Sequence
  Synthetic oligonucleotide
aggtgagatcttgtctgcagttctaag

SEQ ID NO: 9422 - DNA, 27 bp, Artificial Sequence
  Synthetic oligonucleotide
ggtgagatcttgtctgcagttctaagt

SEQ ID NO: 9423 - DNA, 27 bp, Artificial Sequence
  Synthetic oligonucleotide
gtgagatcttgtctgcagttctaagtc

SEQ ID NO: 9424 - DNA, 27 bp, Artificial Sequence
  Synthetic oligonucleotide
tgagatcttgtctgcagttctaagtca

SEQ ID NO: 9425 - DNA, 27 bp, Artificial Sequence
  Synthetic oligonucleotide
gagatcttgtctgcagttctaagtcag

SEQ ID NO: 9426 - DNA, 27 bp, Artificial Sequence
  Synthetic oligonucleotide
agatcttgtctgcagttctaagtcagg

SEQ ID NO: 9427 - DNA, 27 bp, Artificial Sequence
  Synthetic oligonucleotide
gatcttgtctgcagttctaagtcagga

SEQ ID NO: 9428 - DNA, 27 bp, Artificial Sequence
  Synthetic oligonucleotide
atcttgtctgcagttctaagtcaggaa

SEQ ID NO: 9429 - DNA, 27 bp, Artificial Sequence
  Synthetic oligonucleotide
tcttgtctgcagttctaagtcaggaag

SEQ ID NO: 9430 - DNA, 27 bp, Artificial Sequence
  Synthetic oligonucleotide
caggaaggcatcaatatcctaacccac

SEQ ID NO: 9431 - DNA, 27 bp, Artificial Sequence
  Synthetic oligonucleotide
aggaaggcatcaatatcctaacccacc

SEQ ID NO: 9432 - DNA, 27 bp, Artificial Sequence
  Synthetic oligonucleotide
ggaaggcatcaatatcctaacccacct

SEQ ID NO: 9433 - DNA, 27 bp, Artificial Sequence
  Synthetic oligonucleotide
gaaggcatcaatatcctaacccacctc

SEQ ID NO: 9434 - DNA, 27 bp, Artificial Sequence
  Synthetic oligonucleotide
aaggcatcaatatcctaacccacctcc

SEQ ID NO: 9435 - DNA, 27 bp, Artificial Sequence
  Synthetic oligonucleotide
aggcatcaatatcctaacccacctccc

SEQ ID NO: 9436 - DNA, 27 bp, Artificial Sequence
  Synthetic oligonucleotide
ggcatcaatatcctaacccacctcccc

SEQ ID NO: 9437 - DNA, 27 bp, Artificial Sequence
  Synthetic oligonucleotide
gcatcaatatcctaacccacctcccca

SEQ ID NO: 9438 - DNA, 27 bp, Artificial Sequence
  Synthetic oligonucleotide
catcaatatcctaacccacctccccaa

SEQ ID NO: 9439 - DNA, 27 bp, Artificial Sequence
  Synthetic oligonucleotide
atcaatatcctaacccacctccccaaa

SEQ ID NO: 9440 - DNA, 27 bp, Artificial Sequence
  Synthetic oligonucleotide
tcaatatcctaacccacctccccaaag

SEQ ID NO: 9441 - DNA, 27 bp, Artificial Sequence
  Synthetic oligonucleotide
caatatcctaacccacctccccaaagg

SEQ ID NO: 9442 - DNA, 27 bp, Artificial Sequence
  Synthetic oligonucleotide
aatatcctaacccacctccccaaaggg

SEQ ID NO: 9443 - DNA, 27 bp, Artificial Sequence
  Synthetic oligonucleotide
ctaacccacctccccaaagggagtgca

SEQ ID NO: 9444 - DNA, 27 bp, Artificial Sequence
  Synthetic oligonucleotide
taacccacctccccaaagggagtgcag

SEQ ID NO: 9445 - DNA, 27 bp, Artificial Sequence
  Synthetic oligonucleotide
aacccacctccccaaagggagtgcaga

SEQ ID NO: 9446 - DNA, 27 bp, Artificial Sequence
  Synthetic oligonucleotide
cagaggcggagctgatgagcgttgtcc

SEQ ID NO: 9447 - DNA, 27 bp, Artificial Sequence
  Synthetic oligonucleotide
aggcggagctgatgagcgttgtcccag

SEQ ID NO: 9448 - DNA, 27 bp, Artificial Sequence
  Synthetic oligonucleotide
ggcggagctgatgagcgttgtcccagt

SEQ ID NO: 9449 - DNA, 27 bp, Artificial Sequence
  Synthetic oligonucleotide
gcggagctgatgagcgttgtcccagta

SEQ ID NO: 9450 - DNA, 27 bp, Artificial Sequence
  Synthetic oligonucleotide
cggagctgatgagcgttgtcccagtat

SEQ ID NO: 9451 - DNA, 27 bp, Artificial Sequence
  Synthetic oligonucleotide
ggagctgatgagcgttgtcccagtatt

SEQ ID NO: 9452 - DNA, 27 bp, Artificial Sequence
  Synthetic oligonucleotide
gagctgatgagcgttgtcccagtattc

SEQ ID NO: 9453 - DNA, 27 bp, Artificial Sequence
  Synthetic oligonucleotide
agctgatgagcgttgtcccagtattct

SEQ ID NO: 9454 - DNA, 27 bp, Artificial Sequence
  Synthetic oligonucleotide
gctgatgagcgttgtcccagtattcta

SEQ ID NO: 9455 - DNA, 27 bp, Artificial Sequence
  Synthetic oligonucleotide
ctgatgagcgttgtcccagtattctat

SEQ ID NO: 9456 - DNA, 27 bp, Artificial Sequence
  Synthetic oligonucleotide
tgatgagcgttgtcccagtattctatg

SEQ ID NO: 9457 - DNA, 27 bp, Artificial Sequence
  Synthetic oligonucleotide
gatgagcgttgtcccagtattctatgt

SEQ ID NO: 9458 - DNA, 27 bp, Artificial Sequence
  Synthetic oligonucleotide
atgagcgttgtcccagtattctatgtt

SEQ ID NO: 9459 - DNA, 27 bp, Artificial Sequence
  Synthetic oligonucleotide
tgagcgttgtcccagtattctatgttt

SEQ ID NO: 9460 - DNA, 27 bp, Artificial Sequence
  Synthetic oligonucleotide
gagcgttgtcccagtattctatgtttt

SEQ ID NO: 9461 - DNA, 27 bp, Artificial Sequence
  Synthetic oligonucleotide
agcgttgtcccagtattctatgttttt

SEQ ID NO: 9462 - DNA, 27 bp, Artificial Sequence
  Synthetic oligonucleotide
gcgttgtcccagtattctatgtttttc

SEQ ID NO: 9463 - DNA, 27 bp, Artificial Sequence
  Synthetic oligonucleotide
cgttgtcccagtattctatgtttttca

SEQ ID NO: 9464 - DNA, 27 bp, Artificial Sequence
  Synthetic oligonucleotide
gttgtcccagtattctatgtttttcac

SEQ ID NO: 9465 - DNA, 27 bp, Artificial Sequence
  Synthetic oligonucleotide
ttgtcccagtattctatgtttttcact

SEQ ID NO: 9466 - DNA, 27 bp, Artificial Sequence
  Synthetic oligonucleotide
tgtcccagtattctatgtttttcacta

SEQ ID NO: 9467 - DNA, 27 bp, Artificial Sequence
  Synthetic oligonucleotide
gtcccagtattctatgtttttcactac

SEQ ID NO: 9468 - DNA, 27 bp, Artificial Sequence
  Synthetic oligonucleotide
cccagtattctatgtttttcactacct

SEQ ID NO: 9469 - DNA, 27 bp, Artificial Sequence
  Synthetic oligonucleotide
ccagtattctatgtttttcactacctg

SEQ ID NO: 9470 - DNA, 27 bp, Artificial Sequence
  Synthetic oligonucleotide
cagtattctatgtttttcactacctgg

SEQ ID NO: 9471 - DNA, 27 bp, Artificial Sequence
  Synthetic oligonucleotide
agtattctatgtttttcactacctgga

SEQ ID NO: 9472 - DNA, 27 bp, Artificial Sequence
  Synthetic oligonucleotide
gtattctatgtttttcactacctggaa

SEQ ID NO: 9473 - DNA, 27 bp, Artificial Sequence
  Synthetic oligonucleotide
tattctatgtttttcactacctggaaa

SEQ ID NO: 9474 - DNA, 27 bp, Artificial Sequence
  Synthetic oligonucleotide
attctatgtttttcactacctggaaac

SEQ ID NO: 9475 - DNA, 27 bp, Artificial Sequence
  Synthetic oligonucleotide
ttctatgtttttcactacctggaaaca

SEQ ID NO: 9476 - DNA, 27 bp, Artificial Sequence
  Synthetic oligonucleotide
tctatgtttttcactacctggaaacag

SEQ ID NO: 9477 - DNA, 27 bp, Artificial Sequence
  Synthetic oligonucleotide
ctatgtttttcactacctggaaacagg

SEQ ID NO: 9478 - DNA, 27 bp, Artificial Sequence
  Synthetic oligonucleotide
tatgtttttcactacctggaaacagga

SEQ ID NO: 9479 - DNA, 27 bp, Artificial Sequence
  Synthetic oligonucleotide
atgtttttcactacctggaaacaggaa

SEQ ID NO: 9480 - DNA, 27 bp, Artificial Sequence
  Synthetic oligonucleotide
tgtttttcactacctggaaacaggaaa

SEQ ID NO: 9481 - DNA, 27 bp, Artificial Sequence
  Synthetic oligonucleotide
gtttttcactacctggaaacaggaaat

SEQ ID NO: 9482 - DNA, 27 bp, Artificial Sequence
  Synthetic oligonucleotide
tttttcactacctggaaacaggaaatc

SEQ ID NO: 9483 - DNA, 27 bp, Artificial Sequence
  Synthetic oligonucleotide
ttttcactacctggaaacaggaaatca

SEQ ID NO: 9484 - DNA, 27 bp, Artificial Sequence
  Synthetic oligonucleotide
tttcactacctggaaacaggaaatcat

SEQ ID NO: 9485 - DNA, 27 bp, Artificial Sequence
  Synthetic oligonucleotide
ttcactacctggaaacaggaaatcatt

SEQ ID NO: 9486 - DNA, 27 bp, Artificial Sequence
  Synthetic oligonucleotide
tcactacctggaaacaggaaatcattg

SEQ ID NO: 9487 - DNA, 27 bp, Artificial Sequence
  Synthetic oligonucleotide
cactacctggaaacaggaaatcattgg

SEQ ID NO: 9488 - DNA, 27 bp, Artificial Sequence
  Synthetic oligonucleotide
actacctggaaacaggaaatcattgga

SEQ ID NO: 9489 - DNA, 27 bp, Artificial Sequence
  Synthetic oligonucleotide
ctacctggaaacaggaaatcattggaa

SEQ ID NO: 9490 - DNA, 27 bp, Artificial Sequence
  Synthetic oligonucleotide
tacctggaaacaggaaatcattggaac

SEQ ID NO: 9491 - DNA, 27 bp, Artificial Sequence
  Synthetic oligonucleotide
acctggaaacaggaaatcattggaaca

SEQ ID NO: 9492 - DNA, 27 bp, Artificial Sequence
  Synthetic oligonucleotide
cctggaaacaggaaatcattggaacat

SEQ ID NO: 9493 - DNA, 27 bp, Artificial Sequence
  Synthetic oligonucleotide
ctggaaacaggaaatcattggaacatt

SEQ ID NO: 9494 - DNA, 27 bp, Artificial Sequence
  Synthetic oligonucleotide
tggaaacaggaaatcattggaacattt

SEQ ID NO: 9495 - DNA, 27 bp, Artificial Sequence
  Synthetic oligonucleotide
ggaaacaggaaatcattggaacatttt

SEQ ID NO: 9496 - DNA, 27 bp, Artificial Sequence
  Synthetic oligonucleotide
gaaacaggaaatcattggaacattttt

SEQ ID NO: 9497 - DNA, 27 bp, Artificial Sequence
  Synthetic oligonucleotide
aaacaggaaatcattggaacatttttc

SEQ ID NO: 9498 - DNA, 27 bp, Artificial Sequence
  Synthetic oligonucleotide
aacaggaaatcattggaacatttttca

SEQ ID NO: 9499 - DNA, 27 bp, Artificial Sequence
  Synthetic oligonucleotide
aggaaatcattggaacatttttcattc

SEQ ID NO: 9500 - DNA, 27 bp, Artificial Sequence
  Synthetic oligonucleotide
ggaaatcattggaacatttttcattct

SEQ ID NO: 9501 - DNA, 27 bp, Artificial Sequence
  Synthetic oligonucleotide
gaaatcattggaacatttttcattctg

SEQ ID NO: 9502 - DNA, 27 bp, Artificial Sequence
  Synthetic oligonucleotide
aaatcattggaacatttttcattctga

SEQ ID NO: 9503 - DNA, 27 bp, Artificial Sequence
  Synthetic oligonucleotide
aatcattggaacatttttcattctgac

SEQ ID NO: 9504 - DNA, 27 bp, Artificial Sequence
  Synthetic oligonucleotide
atcattggaacatttttcattctgacc

SEQ ID NO: 9505 - DNA, 27 bp, Artificial Sequence
  Synthetic oligonucleotide
tcattggaacatttttcattctgaccc

SEQ ID NO: 9506 - DNA, 27 bp, Artificial Sequence
  Synthetic oligonucleotide
ctgacccattaattgaaaagcagaaac

SEQ ID NO: 9507 - DNA, 27 bp, Artificial Sequence
  Synthetic oligonucleotide
gaagaaaaaattaaaagaagggatgtt

SEQ ID NO: 9508 - DNA, 27 bp, Artificial Sequence
  Synthetic oligonucleotide
aagaaaaaattaaaagaagggatgttg

SEQ ID NO: 9509 - DNA, 27 bp, Artificial Sequence
  Synthetic oligonucleotide
agaaaaaattaaaagaagggatgttga

SEQ ID NO: 9510 - DNA, 27 bp, Artificial Sequence
  Synthetic oligonucleotide
gaaaaaattaaaagaagggatgttgag

SEQ ID NO: 9511 - DNA, 27 bp, Artificial Sequence
  Synthetic oligonucleotide
aaaaaattaaaagaagggatgttgagc

SEQ ID NO: 9512 - DNA, 27 bp, Artificial Sequence
  Synthetic oligonucleotide
gttgagcattatgtcctacagaaatgc

SEQ ID NO: 9513 - DNA, 27 bp, Artificial Sequence
  Synthetic oligonucleotide
tgagcattatgtcctacagaaatgctg

SEQ ID NO: 9514 - DNA, 27 bp, Artificial Sequence
  Synthetic oligonucleotide
gagcattatgtcctacagaaatgctga

SEQ ID NO: 9515 - DNA, 27 bp, Artificial Sequence
  Synthetic oligonucleotide
agcattatgtcctacagaaatgctgac

SEQ ID NO: 9516 - DNA, 27 bp, Artificial Sequence
  Synthetic oligonucleotide
gcattatgtcctacagaaatgctgact

SEQ ID NO: 9517 - DNA, 27 bp, Artificial Sequence
  Synthetic oligonucleotide
cattatgtcctacagaaatgctgacta

SEQ ID NO: 9518 - DNA, 27 bp, Artificial Sequence
  Synthetic oligonucleotide
attatgtcctacagaaatgctgactac

SEQ ID NO: 9519 - DNA, 27 bp, Artificial Sequence
  Synthetic oligonucleotide
ttatgtcctacagaaatgctgactact

SEQ ID NO: 9520 - DNA, 27 bp, Artificial Sequence
  Synthetic oligonucleotide
tatgtcctacagaaatgctgactactc

SEQ ID NO: 9521 - DNA, 27 bp, Artificial Sequence
  Synthetic oligonucleotide
atgtcctacagaaatgctgactactct

SEQ ID NO: 9522 - DNA, 27 bp, Artificial Sequence
  Synthetic oligonucleotide
tgtcctacagaaatgctgactactctt

SEQ ID NO: 9523 - DNA, 27 bp, Artificial Sequence
  Synthetic oligonucleotide
gtcctacagaaatgctgactactctta

SEQ ID NO: 9524 - DNA, 27 bp, Artificial Sequence
  Synthetic oligonucleotide
gaagtgctagcacttggttaacagctt

SEQ ID NO: 9525 - DNA, 27 bp, Artificial Sequence
  Synthetic oligonucleotide
aagtgctagcacttggttaacagcttt

SEQ ID NO: 9526 - DNA, 27 bp, Artificial Sequence
  Synthetic oligonucleotide
agtgctagcacttggttaacagctttt

SEQ ID NO: 9527 - DNA, 27 bp, Artificial Sequence
  Synthetic oligonucleotide
gtgctagcacttggttaacagcttttg

SEQ ID NO: 9528 - DNA, 27 bp, Artificial Sequence
  Synthetic oligonucleotide
tgctagcacttggttaacagcttttgc

SEQ ID NO: 9529 - DNA, 27 bp, Artificial Sequence
  Synthetic oligonucleotide
gctagcacttggttaacagcttttgct

SEQ ID NO: 9530 - DNA, 27 bp, Artificial Sequence
  Synthetic oligonucleotide
ctagcacttggttaacagcttttgctt

SEQ ID NO: 9531 - DNA, 27 bp, Artificial Sequence
  Synthetic oligonucleotide
tagcacttggttaacagcttttgcttt

SEQ ID NO: 9532 - DNA, 27 bp, Artificial Sequence
  Synthetic oligonucleotide
agcacttggttaacagcttttgcttta

SEQ ID NO: 9533 - DNA, 27 bp, Artificial Sequence
  Synthetic oligonucleotide
gcacttggttaacagcttttgctttaa

SEQ ID NO: 9534 - DNA, 27 bp, Artificial Sequence
  Synthetic oligonucleotide
acttggttaacagcttttgctttaaga

SEQ ID NO: 9535 - DNA, 27 bp, Artificial Sequence
  Synthetic oligonucleotide
cttggttaacagcttttgctttaagag

SEQ ID NO: 9536 - DNA, 27 bp, Artificial Sequence
  Synthetic oligonucleotide
ggttaacagcttttgctttaagagtac

SEQ ID NO: 9537 - DNA, 27 bp, Artificial Sequence
  Synthetic oligonucleotide
gttaacagcttttgctttaagagtact

SEQ ID NO: 9538 - DNA, 27 bp, Artificial Sequence
  Synthetic oligonucleotide
ttaacagcttttgctttaagagtactt

SEQ ID NO: 9539 - DNA, 27 bp, Artificial Sequence
  Synthetic oligonucleotide
taacagcttttgctttaagagtacttg

SEQ ID NO: 9540 - DNA, 27 bp, Artificial Sequence
  Synthetic oligonucleotide
aacagcttttgctttaagagtacttgg

SEQ ID NO: 9541 - DNA, 27 bp, Artificial Sequence
  Synthetic oligonucleotide
acagcttttgctttaagagtacttgga

SEQ ID NO: 9542 - DNA, 27 bp, Artificial Sequence
  Synthetic oligonucleotide
cagcttttgctttaagagtacttggac

SEQ ID NO: 9543 - DNA, 27 bp, Artificial Sequence
  Synthetic oligonucleotide
agcttttgctttaagagtacttggaca

SEQ ID NO: 9544 - DNA, 27 bp, Artificial Sequence
  Synthetic oligonucleotide
gcttttgctttaagagtacttggacaa

SEQ ID NO: 9545 - DNA, 27 bp, Artificial Sequence
  Synthetic oligonucleotide
cttttgctttaagagtacttggacaag

SEQ ID NO: 9546 - DNA, 27 bp, Artificial Sequence
  Synthetic oligonucleotide
ttttgctttaagagtacttggacaagt

SEQ ID NO: 9547 - DNA, 27 bp, Artificial Sequence
  Synthetic oligonucleotide
tttgctttaagagtacttggacaagta

SEQ ID NO: 9548 - DNA, 27 bp, Artificial Sequence
  Synthetic oligonucleotide
gctttaagagtacttggacaagtaaat

SEQ ID NO: 9549 - DNA, 27 bp, Artificial Sequence
  Synthetic oligonucleotide
ctttaagagtacttggacaagtaaata

SEQ ID NO: 9550 - DNA, 27 bp, Artificial Sequence
  Synthetic oligonucleotide
acgtagagcagaaccaaaattcaattt

SEQ ID NO: 9551 - DNA, 27 bp, Artificial Sequence
  Synthetic oligonucleotide
tttgtaattctttattgtggctagttg

SEQ ID NO: 9552 - DNA, 27 bp, Artificial Sequence
  Synthetic oligonucleotide
ttgtaattctttattgtggctagttga

SEQ ID NO: 9553 - DNA, 27 bp, Artificial Sequence
  Synthetic oligonucleotide
ctttcaaggaaaattcacagtatcaac

SEQ ID NO: 9554 - DNA, 27 bp, Artificial Sequence
  Synthetic oligonucleotide
tttcaaggaaaattcacagtatcaacc

SEQ ID NO: 9555 - DNA, 27 bp, Artificial Sequence
  Synthetic oligonucleotide
ttcaaggaaaattcacagtatcaacca

SEQ ID NO: 9556 - DNA, 27 bp, Artificial Sequence
  Synthetic oligonucleotide
tcaaggaaaattcacagtatcaaccaa

SEQ ID NO: 9557 - DNA, 27 bp, Artificial Sequence
  Synthetic oligonucleotide
caaggaaaattcacagtatcaaccaat

SEQ ID NO: 9558 - DNA, 27 bp, Artificial Sequence
  Synthetic oligonucleotide
aaggaaaattcacagtatcaaccaata

SEQ ID NO: 9559 - DNA, 27 bp, Artificial Sequence
  Synthetic oligonucleotide
aggaaaattcacagtatcaaccaataa

SEQ ID NO: 9560 - DNA, 27 bp, Artificial Sequence
  Synthetic oligonucleotide
ggaaaattcacagtatcaaccaataaa

SEQ ID NO: 9561 - DNA, 27 bp, Artificial Sequence
  Synthetic oligonucleotide
gaaaattcacagtatcaaccaataaaa

SEQ ID NO: 9562 - DNA, 27 bp, Artificial Sequence
  Synthetic oligonucleotide
aaaattcacagtatcaaccaataaaat

SEQ ID NO: 9563 - DNA, 27 bp, Artificial Sequence
  Synthetic oligonucleotide
aaattcacagtatcaaccaataaaatt

SEQ ID NO: 9564 - DNA, 27 bp, Artificial Sequence
  Synthetic oligonucleotide
aattcacagtatcaaccaataaaatta

SEQ ID NO: 9565 - DNA, 27 bp, Artificial Sequence
  Synthetic oligonucleotide
attcacagtatcaaccaataaaattac

SEQ ID NO: 9566 - DNA, 27 bp, Artificial Sequence
  Synthetic oligonucleotide
tcacagtatcaaccaataaaattacag

SEQ ID NO: 9567 - DNA, 27 bp, Artificial Sequence
  Synthetic oligonucleotide
cacagtatcaaccaataaaattacagg

SEQ ID NO: 9568 - DNA, 27 bp, Artificial Sequence
  Synthetic oligonucleotide
acagtatcaaccaataaaattacaggg

SEQ ID NO: 9569 - DNA, 27 bp, Artificial Sequence
  Synthetic oligonucleotide
cagtatcaaccaataaaattacagggt

SEQ ID NO: 9570 - DNA, 27 bp, Artificial Sequence
  Synthetic oligonucleotide
agtatcaaccaataaaattacagggta

SEQ ID NO: 9571 - DNA, 27 bp, Artificial Sequence
  Synthetic oligonucleotide
gtatcaaccaataaaattacagggtac

SEQ ID NO: 9572 - DNA, 27 bp, Artificial Sequence
  Synthetic oligonucleotide
tatcaaccaataaaattacagggtacc

SEQ ID NO: 9573 - DNA, 27 bp, Artificial Sequence
  Synthetic oligonucleotide
cacagctctaattaaagctgacaactt

SEQ ID NO: 9574 - DNA, 27 bp, Artificial Sequence
  Synthetic oligonucleotide
acagctctaattaaagctgacaacttt

SEQ ID NO: 9575 - DNA, 27 bp, Artificial Sequence
  Synthetic oligonucleotide
cagctctaattaaagctgacaactttc

SEQ ID NO: 9576 - DNA, 27 bp, Artificial Sequence
  Synthetic oligonucleotide
aactttctgcttgaaaatacactgcca

SEQ ID NO: 9577 - DNA, 27 bp, Artificial Sequence
  Synthetic oligonucleotide
actttctgcttgaaaatacactgccag

SEQ ID NO: 9578 - DNA, 27 bp, Artificial Sequence
  Synthetic oligonucleotide
ctttctgcttgaaaatacactgccagc

SEQ ID NO: 9579 - DNA, 27 bp, Artificial Sequence
  Synthetic oligonucleotide
tttctgcttgaaaatacactgccagcc

SEQ ID NO: 9580 - DNA, 27 bp, Artificial Sequence
  Synthetic oligonucleotide
ttctgcttgaaaatacactgccagccc

SEQ ID NO: 9581 - DNA, 27 bp, Artificial Sequence
  Synthetic oligonucleotide
tctgcttgaaaatacactgccagccca

SEQ ID NO: 9582 - DNA, 27 bp, Artificial Sequence
  Synthetic oligonucleotide
ctgcttgaaaatacactgccagcccag

SEQ ID NO: 9583 - DNA, 27 bp, Artificial Sequence
  Synthetic oligonucleotide
tgcttgaaaatacactgccagcccaga

SEQ ID NO: 9584 - DNA, 27 bp, Artificial Sequence
  Synthetic oligonucleotide
gcttgaaaatacactgccagcccagag

SEQ ID NO: 9585 - DNA, 27 bp, Artificial Sequence
  Synthetic oligonucleotide
cttgaaaatacactgccagcccagagc

SEQ ID NO: 9586 - DNA, 27 bp, Artificial Sequence
  Synthetic oligonucleotide
ttgaaaatacactgccagcccagagca

SEQ ID NO: 9587 - DNA, 27 bp, Artificial Sequence
  Synthetic oligonucleotide
tgaaaatacactgccagcccagagcac

SEQ ID NO: 9588 - DNA, 27 bp, Artificial Sequence
  Synthetic oligonucleotide
gaaaatacactgccagcccagagcacc

SEQ ID NO: 9589 - DNA, 27 bp, Artificial Sequence
  Synthetic oligonucleotide
aaaatacactgccagcccagagcacct

SEQ ID NO: 9590 - DNA, 27 bp, Artificial Sequence
  Synthetic oligonucleotide
aaatacactgccagcccagagcacctt

SEQ ID NO: 9591 - DNA, 27 bp, Artificial Sequence
  Synthetic oligonucleotide
aatacactgccagcccagagcaccttt

SEQ ID NO: 9592 - DNA, 27 bp, Artificial Sequence
  Synthetic oligonucleotide
atacactgccagcccagagcaccttta

SEQ ID NO: 9593 - DNA, 27 bp, Artificial Sequence
  Synthetic oligonucleotide
tacactgccagcccagagcacctttac

SEQ ID NO: 9594 - DNA, 27 bp, Artificial Sequence
  Synthetic oligonucleotide
acactgccagcccagagcacctttaca

SEQ ID NO: 9595 - DNA, 27 bp, Artificial Sequence
  Synthetic oligonucleotide
cactgccagcccagagcacctttacat

SEQ ID NO: 9596 - DNA, 27 bp, Artificial Sequence
  Synthetic oligonucleotide
actgccagcccagagcacctttacatt

SEQ ID NO: 9597 - DNA, 27 bp, Artificial Sequence
  Synthetic oligonucleotide
ctgccagcccagagcacctttacattg

SEQ ID NO: 9598 - DNA, 27 bp, Artificial Sequence
  Synthetic oligonucleotide
tgccagcccagagcacctttacattgg

SEQ ID NO: 9599 - DNA, 27 bp, Artificial Sequence
  Synthetic oligonucleotide
gccagcccagagcacctttacattggc

SEQ ID NO: 9600 - DNA, 27 bp, Artificial Sequence
  Synthetic oligonucleotide
ccagcccagagcacctttacattggcc

SEQ ID NO: 9601 - DNA, 27 bp, Artificial Sequence
  Synthetic oligonucleotide
cagcccagagcacctttacattggcca

SEQ ID NO: 9602 - DNA, 27 bp, Artificial Sequence
  Synthetic oligonucleotide
agcccagagcacctttacattggccat

SEQ ID NO: 9603 - DNA, 27 bp, Artificial Sequence
  Synthetic oligonucleotide
gcccagagcacctttacattggccatt

SEQ ID NO: 9604 - DNA, 27 bp, Artificial Sequence
  Synthetic oligonucleotide
cccagagcacctttacattggccattt

SEQ ID NO: 9605 - DNA, 27 bp, Artificial Sequence
  Synthetic oligonucleotide
ccagagcacctttacattggccatttc

SEQ ID NO: 9606 - DNA, 27 bp, Artificial Sequence
  Synthetic oligonucleotide
cagagcacctttacattggccatttct

SEQ ID NO: 9607 - DNA, 27 bp, Artificial Sequence
  Synthetic oligonucleotide
agagcacctttacattggccatttctg

SEQ ID NO: 9608 - DNA, 27 bp, Artificial Sequence
  Synthetic oligonucleotide
gagcacctttacattggccatttctgc

SEQ ID NO: 9609 - DNA, 27 bp, Artificial Sequence
  Synthetic oligonucleotide
agcacctttacattggccatttctgcg

SEQ ID NO: 9610 - DNA, 27 bp, Artificial Sequence
  Synthetic oligonucleotide
gcacctttacattggccatttctgcgt

SEQ ID NO: 9611 - DNA, 27 bp, Artificial Sequence
  Synthetic oligonucleotide
cacctttacattggccatttctgcgta

SEQ ID NO: 9612 - DNA, 27 bp, Artificial Sequence
  Synthetic oligonucleotide
acctttacattggccatttctgcgtat

SEQ ID NO: 9613 - DNA, 27 bp, Artificial Sequence
  Synthetic oligonucleotide
cctttacattggccatttctgcgtatg

SEQ ID NO: 9614 - DNA, 27 bp, Artificial Sequence
  Synthetic oligonucleotide
ctttacattggccatttctgcgtatgc

SEQ ID NO: 9615 - DNA, 27 bp, Artificial Sequence
  Synthetic oligonucleotide
cgtatgctctttccctgggagataaaa

SEQ ID NO: 9616 - DNA, 27 bp, Artificial Sequence
  Synthetic oligonucleotide
gtatgctctttccctgggagataaaac

SEQ ID NO: 9617 - DNA, 27 bp, Artificial Sequence
  Synthetic oligonucleotide
tatgctctttccctgggagataaaact

SEQ ID NO: 9618 - DNA, 27 bp, Artificial Sequence
  Synthetic oligonucleotide
atgctctttccctgggagataaaactc

SEQ ID NO: 9619 - DNA, 27 bp, Artificial Sequence
  Synthetic oligonucleotide
tgctctttccctgggagataaaactca

SEQ ID NO: 9620 - DNA, 27 bp, Artificial Sequence
  Synthetic oligonucleotide
gctctttccctgggagataaaactcac

SEQ ID NO: 9621 - DNA, 27 bp, Artificial Sequence
  Synthetic oligonucleotide
ctctttccctgggagataaaactcacc

SEQ ID NO: 9622 - DNA, 27 bp, Artificial Sequence
  Synthetic oligonucleotide
tctttccctgggagataaaactcaccc

SEQ ID NO: 9623 - DNA, 27 bp, Artificial Sequence
  Synthetic oligonucleotide
ctttccctgggagataaaactcaccca

SEQ ID NO: 9624 - DNA, 27 bp, Artificial Sequence
  Synthetic oligonucleotide
tttccctgggagataaaactcacccac

SEQ ID NO: 9625 - DNA, 27 bp, Artificial Sequence
  Synthetic oligonucleotide
ttccctgggagataaaactcacccaca

SEQ ID NO: 9626 - DNA, 27 bp, Artificial Sequence
  Synthetic oligonucleotide
tccctgggagataaaactcacccacag

SEQ ID NO: 9627 - DNA, 27 bp, Artificial Sequence
  Synthetic oligonucleotide
ccctgggagataaaactcacccacagt

SEQ ID NO: 9628 - DNA, 27 bp, Artificial Sequence
  Synthetic oligonucleotide
cctgggagataaaactcacccacagtt

SEQ ID NO: 9629 - DNA, 27 bp, Artificial Sequence
  Synthetic oligonucleotide
ctgggagataaaactcacccacagttt

SEQ ID NO: 9630 - DNA, 27 bp, Artificial Sequence
  Synthetic oligonucleotide
tgggagataaaactcacccacagtttc

SEQ ID NO: 9631 - DNA, 27 bp, Artificial Sequence
  Synthetic oligonucleotide
gggagataaaactcacccacagtttcg

SEQ ID NO: 9632 - DNA, 27 bp, Artificial Sequence
  Synthetic oligonucleotide
ggagataaaactcacccacagtttcgt

SEQ ID NO: 9633 - DNA, 27 bp, Artificial Sequence
  Synthetic oligonucleotide
gagataaaactcacccacagtttcgtt

SEQ ID NO: 9634 - DNA, 27 bp, Artificial Sequence
  Synthetic oligonucleotide
agataaaactcacccacagtttcgttc

SEQ ID NO: 9635 - DNA, 27 bp, Artificial Sequence
  Synthetic oligonucleotide
gataaaactcacccacagtttcgttca

SEQ ID NO: 9636 - DNA, 27 bp, Artificial Sequence
  Synthetic oligonucleotide
tcgttcaattgtttcagctttgaagag

SEQ ID NO: 9637 - DNA, 27 bp, Artificial Sequence
  Synthetic oligonucleotide
gttcaattgtttcagctttgaagagag

SEQ ID NO: 9638 - DNA, 27 bp, Artificial Sequence
  Synthetic oligonucleotide
ttcaattgtttcagctttgaagagaga

SEQ ID NO: 9639 - DNA, 27 bp, Artificial Sequence
  Synthetic oligonucleotide
tcaattgtttcagctttgaagagagaa

SEQ ID NO: 9640 - DNA, 27 bp, Artificial Sequence
  Synthetic oligonucleotide
caattgtttcagctttgaagagagaag

SEQ ID NO: 9641 - DNA, 27 bp, Artificial Sequence
  Synthetic oligonucleotide
aattgtttcagctttgaagagagaagc

SEQ ID NO: 9642 - DNA, 27 bp, Artificial Sequence
  Synthetic oligonucleotide
attgtttcagctttgaagagagaagct

SEQ ID NO: 9643 - DNA, 27 bp, Artificial Sequence
  Synthetic oligonucleotide
ttgtttcagctttgaagagagaagctt

SEQ ID NO: 9644 - DNA, 27 bp, Artificial Sequence
  Synthetic oligonucleotide
tgtttcagctttgaagagagaagcttt

SEQ ID NO: 9645 - DNA, 27 bp, Artificial Sequence
  Synthetic oligonucleotide
gtttcagctttgaagagagaagctttg

SEQ ID NO: 9646 - DNA, 27 bp, Artificial Sequence
  Synthetic oligonucleotide
tttcagctttgaagagagaagctttgg

SEQ ID NO: 9647 - DNA, 27 bp, Artificial Sequence
  Synthetic oligonucleotide
ttcagctttgaagagagaagctttggt

SEQ ID NO: 9648 - DNA, 27 bp, Artificial Sequence
  Synthetic oligonucleotide
tcagctttgaagagagaagctttggtt

SEQ ID NO: 9649 - DNA, 27 bp, Artificial Sequence
  Synthetic oligonucleotide
cagctttgaagagagaagctttggtta

SEQ ID NO: 9650 - DNA, 27 bp, Artificial Sequence
  Synthetic oligonucleotide
agctttgaagagagaagctttggttaa

SEQ ID NO: 9651 - DNA, 27 bp, Artificial Sequence
  Synthetic oligonucleotide
gctttgaagagagaagctttggttaaa

SEQ ID NO: 9652 - DNA, 27 bp, Artificial Sequence
  Synthetic oligonucleotide
ctttgaagagagaagctttggttaaag

SEQ ID NO: 9653 - DNA, 27 bp, Artificial Sequence
  Synthetic oligonucleotide
tttgaagagagaagctttggttaaagg

SEQ ID NO: 9654 - DNA, 27 bp, Artificial Sequence
  Synthetic oligonucleotide
aagagagaagctttggttaaaggtaat

SEQ ID NO: 9655 - DNA, 27 bp, Artificial Sequence
  Synthetic oligonucleotide
agagagaagctttggttaaaggtaatc

SEQ ID NO: 9656 - DNA, 27 bp, Artificial Sequence
  Synthetic oligonucleotide
gagagaagctttggttaaaggtaatcc

SEQ ID NO: 9657 - DNA, 27 bp, Artificial Sequence
  Synthetic oligonucleotide
agaagctttggttaaaggtaatccacc

SEQ ID NO: 9658 - DNA, 27 bp, Artificial Sequence
  Synthetic oligonucleotide
gaagctttggttaaaggtaatccaccc

SEQ ID NO: 9659 - DNA, 27 bp, Artificial Sequence
  Synthetic oligonucleotide
aagctttggttaaaggtaatccaccca

SEQ ID NO: 9660 - DNA, 27 bp, Artificial Sequence
  Synthetic oligonucleotide
agctttggttaaaggtaatccacccat

SEQ ID NO: 9661 - DNA, 27 bp, Artificial Sequence
  Synthetic oligonucleotide
gctttggttaaaggtaatccacccatt

SEQ ID NO: 9662 - DNA, 27 bp, Artificial Sequence
  Synthetic oligonucleotide
ctttggttaaaggtaatccacccattt

SEQ ID NO: 9663 - DNA, 27 bp, Artificial Sequence
  Synthetic oligonucleotide
tttggttaaaggtaatccacccattta

SEQ ID NO: 9664 - DNA, 27 bp, Artificial Sequence
  Synthetic oligonucleotide
ttggttaaaggtaatccacccatttat

SEQ ID NO: 9665 - DNA, 27 bp, Artificial Sequence
  Synthetic oligonucleotide
tggttaaaggtaatccacccatttatc

SEQ ID NO: 9666 - DNA, 27 bp, Artificial Sequence
  Synthetic oligonucleotide
ggttaaaggtaatccacccatttatcg

SEQ ID NO: 9667 - DNA, 27 bp, Artificial Sequence
  Synthetic oligonucleotide
gttaaaggtaatccacccatttatcgt

SEQ ID NO: 9668 - DNA, 27 bp, Artificial Sequence
  Synthetic oligonucleotide
ttaaaggtaatccacccatttatcgtt

SEQ ID NO: 9669 - DNA, 27 bp, Artificial Sequence
  Synthetic oligonucleotide
taaaggtaatccacccatttatcgttt

SEQ ID NO: 9670 - DNA, 27 bp, Artificial Sequence
  Synthetic oligonucleotide
aaaggtaatccacccatttatcgtttt

SEQ ID NO: 9671 - DNA, 27 bp, Artificial Sequence
  Synthetic oligonucleotide
aaggtaatccacccatttatcgttttt

SEQ ID NO: 9672 - DNA, 27 bp, Artificial Sequence
  Synthetic oligonucleotide
aggtaatccacccatttatcgtttttg

SEQ ID NO: 9673 - DNA, 27 bp, Artificial Sequence
  Synthetic oligonucleotide
ggtaatccacccatttatcgtttttgg

SEQ ID NO: 9674 - DNA, 27 bp, Artificial Sequence
  Synthetic oligonucleotide
gtaatccacccatttatcgtttttgga

SEQ ID NO: 9675 - DNA, 27 bp, Artificial Sequence
  Synthetic oligonucleotide
taatccacccatttatcgtttttggaa

SEQ ID NO: 9676 - DNA, 27 bp, Artificial Sequence
  Synthetic oligonucleotide
aatccacccatttatcgtttttggaaa

SEQ ID NO: 9677 - DNA, 27 bp, Artificial Sequence
  Synthetic oligonucleotide
atccacccatttatcgtttttggaaag

SEQ ID NO: 9678 - DNA, 27 bp, Artificial Sequence
  Synthetic oligonucleotide
tccacccatttatcgtttttggaaaga

SEQ ID NO: 9679 - DNA, 27 bp, Artificial Sequence
  Synthetic oligonucleotide
ccacccatttatcgtttttggaaagac

SEQ ID NO: 9680 - DNA, 27 bp, Artificial Sequence
  Synthetic oligonucleotide
cacccatttatcgtttttggaaagaca

SEQ ID NO: 9681 - DNA, 27 bp, Artificial Sequence
  Synthetic oligonucleotide
cccatttatcgtttttggaaagacaat

SEQ ID NO: 9682 - DNA, 27 bp, Artificial Sequence
  Synthetic oligonucleotide
ccatttatcgtttttggaaagacaatc

SEQ ID NO: 9683 - DNA, 27 bp, Artificial Sequence
  Synthetic oligonucleotide
catttatcgtttttggaaagacaatct

SEQ ID NO: 9684 - DNA, 27 bp, Artificial Sequence
  Synthetic oligonucleotide
atttatcgtttttggaaagacaatctt

SEQ ID NO: 9685 - DNA, 27 bp, Artificial Sequence
  Synthetic oligonucleotide
tttatcgtttttggaaagacaatcttc

SEQ ID NO: 9686 - DNA, 27 bp, Artificial Sequence
  Synthetic oligonucleotide
agcataaagacagctctgtacctaaca

SEQ ID NO: 9687 - DNA, 27 bp, Artificial Sequence
  Synthetic oligonucleotide
gcataaagacagctctgtacctaacac

SEQ ID NO: 9688 - DNA, 27 bp, Artificial Sequence
  Synthetic oligonucleotide
cataaagacagctctgtacctaacact

SEQ ID NO: 9689 - DNA, 27 bp, Artificial Sequence
  Synthetic oligonucleotide
ataaagacagctctgtacctaacactg

SEQ ID NO: 9690 - DNA, 27 bp, Artificial Sequence
  Synthetic oligonucleotide
taaagacagctctgtacctaacactgg

SEQ ID NO: 9691 - DNA, 27 bp, Artificial Sequence
  Synthetic oligonucleotide
aaagacagctctgtacctaacactggt

SEQ ID NO: 9692 - DNA, 27 bp, Artificial Sequence
  Synthetic oligonucleotide
aagacagctctgtacctaacactggta

SEQ ID NO: 9693 - DNA, 27 bp, Artificial Sequence
  Synthetic oligonucleotide
agacagctctgtacctaacactggtac

SEQ ID NO: 9694 - DNA, 27 bp, Artificial Sequence
  Synthetic oligonucleotide
gacagctctgtacctaacactggtacg

SEQ ID NO: 9695 - DNA, 27 bp, Artificial Sequence
  Synthetic oligonucleotide
acagctctgtacctaacactggtacgg

SEQ ID NO: 9696 - DNA, 27 bp, Artificial Sequence
  Synthetic oligonucleotide
cagctctgtacctaacactggtacggc

SEQ ID NO: 9697 - DNA, 27 bp, Artificial Sequence
  Synthetic oligonucleotide
agctctgtacctaacactggtacggca

SEQ ID NO: 9698 - DNA, 27 bp, Artificial Sequence
  Synthetic oligonucleotide
gctctgtacctaacactggtacggcac

SEQ ID NO: 9699 - DNA, 27 bp, Artificial Sequence
  Synthetic oligonucleotide
ctctgtacctaacactggtacggcacg

SEQ ID NO: 9700 - DNA, 27 bp, Artificial Sequence
  Synthetic oligonucleotide
cggcacgtatggtagaaacaactgcct

SEQ ID NO: 9701 - DNA, 27 bp, Artificial Sequence
  Synthetic oligonucleotide
ggcacgtatggtagaaacaactgccta

SEQ ID NO: 9702 - DNA, 27 bp, Artificial Sequence
  Synthetic oligonucleotide
gcacgtatggtagaaacaactgcctat

SEQ ID NO: 9703 - DNA, 27 bp, Artificial Sequence
  Synthetic oligonucleotide
cacgtatggtagaaacaactgcctatg

SEQ ID NO: 9704 - DNA, 27 bp, Artificial Sequence
  Synthetic oligonucleotide
acgtatggtagaaacaactgcctatgc

SEQ ID NO: 9705 - DNA, 27 bp, Artificial Sequence
  Synthetic oligonucleotide
cgtatggtagaaacaactgcctatgct

SEQ ID NO: 9706 - DNA, 27 bp, Artificial Sequence
  Synthetic oligonucleotide
gtatggtagaaacaactgcctatgctt

SEQ ID NO: 9707 - DNA, 27 bp, Artificial Sequence
  Synthetic oligonucleotide
tatggtagaaacaactgcctatgcttt

SEQ ID NO: 9708 - DNA, 27 bp, Artificial Sequence
  Synthetic oligonucleotide
atggtagaaacaactgcctatgcttta

SEQ ID NO: 9709 - DNA, 27 bp, Artificial Sequence
  Synthetic oligonucleotide
tggtagaaacaactgcctatgctttac

SEQ ID NO: 9710 - DNA, 27 bp, Artificial Sequence
  Synthetic oligonucleotide
ggtagaaacaactgcctatgctttact

SEQ ID NO: 9711 - DNA, 27 bp, Artificial Sequence
  Synthetic oligonucleotide
gtagaaacaactgcctatgctttactc

SEQ ID NO: 9712 - DNA, 27 bp, Artificial Sequence
  Synthetic oligonucleotide
tagaaacaactgcctatgctttactca

SEQ ID NO: 9713 - DNA, 27 bp, Artificial Sequence
  Synthetic oligonucleotide
agaaacaactgcctatgctttactcac

SEQ ID NO: 9714 - DNA, 27 bp, Artificial Sequence
  Synthetic oligonucleotide
gaaacaactgcctatgctttactcacc

SEQ ID NO: 9715 - DNA, 27 bp, Artificial Sequence
  Synthetic oligonucleotide
aaacaactgcctatgctttactcacca

SEQ ID NO: 9716 - DNA, 27 bp, Artificial Sequence
  Synthetic oligonucleotide
aacaactgcctatgctttactcaccag

SEQ ID NO: 9717 - DNA, 27 bp, Artificial Sequence
  Synthetic oligonucleotide
acaactgcctatgctttactcaccagt

SEQ ID NO: 9718 - DNA, 27 bp, Artificial Sequence
  Synthetic oligonucleotide
caactgcctatgctttactcaccagtc

SEQ ID NO: 9719 - DNA, 27 bp, Artificial Sequence
  Synthetic oligonucleotide
aactgcctatgctttactcaccagtct

SEQ ID NO: 9720 - DNA, 27 bp, Artificial Sequence
  Synthetic oligonucleotide
actgcctatgctttactcaccagtctg

SEQ ID NO: 9721 - DNA, 27 bp, Artificial Sequence
  Synthetic oligonucleotide
ctgcctatgctttactcaccagtctga

SEQ ID NO: 9722 - DNA, 27 bp, Artificial Sequence
  Synthetic oligonucleotide
tgcctatgctttactcaccagtctgaa

SEQ ID NO: 9723 - DNA, 27 bp, Artificial Sequence
  Synthetic oligonucleotide
gcctatgctttactcaccagtctgaac

SEQ ID NO: 9724 - DNA, 27 bp, Artificial Sequence
  Synthetic oligonucleotide
cctatgctttactcaccagtctgaact

SEQ ID NO: 9725 - DNA, 27 bp, Artificial Sequence
  Synthetic oligonucleotide
ctatgctttactcaccagtctgaactt

SEQ ID NO: 9726 - DNA, 27 bp, Artificial Sequence
  Synthetic oligonucleotide
tatgctttactcaccagtctgaacttg

SEQ ID NO: 9727 - DNA, 27 bp, Artificial Sequence
  Synthetic oligonucleotide
gctttactcaccagtctgaacttgaaa

SEQ ID NO: 9728 - DNA, 27 bp, Artificial Sequence
  Synthetic oligonucleotide
ctttactcaccagtctgaacttgaaag

SEQ ID NO: 9729 - DNA, 27 bp, Artificial Sequence
  Synthetic oligonucleotide
tttactcaccagtctgaacttgaaaga

SEQ ID NO: 9730 - DNA, 27 bp, Artificial Sequence
  Synthetic oligonucleotide
ttactcaccagtctgaacttgaaagat

SEQ ID NO: 9731 - DNA, 27 bp, Artificial Sequence
  Synthetic oligonucleotide
actcaccagtctgaacttgaaagatat

SEQ ID NO: 9732 - DNA, 27 bp, Artificial Sequence
  Synthetic oligonucleotide
ctcaccagtctgaacttgaaagatata

SEQ ID NO: 9733 - DNA, 27 bp, Artificial Sequence
  Synthetic oligonucleotide
tcaccagtctgaacttgaaagatataa

SEQ ID NO: 9734 - DNA, 27 bp, Artificial Sequence
  Synthetic oligonucleotide
agtcatcaaatggctatcagaagagca

SEQ ID NO: 9735 - DNA, 27 bp, Artificial Sequence
  Synthetic oligonucleotide
gtcatcaaatggctatcagaagagcag

SEQ ID NO: 9736 - DNA, 27 bp, Artificial Sequence
  Synthetic oligonucleotide
tcatcaaatggctatcagaagagcaga

SEQ ID NO: 9737 - DNA, 27 bp, Artificial Sequence
  Synthetic oligonucleotide
catcaaatggctatcagaagagcagag

SEQ ID NO: 9738 - DNA, 27 bp, Artificial Sequence
  Synthetic oligonucleotide
atcaaatggctatcagaagagcagagg

SEQ ID NO: 9739 - DNA, 27 bp, Artificial Sequence
  Synthetic oligonucleotide
tcaaatggctatcagaagagcagaggt

SEQ ID NO: 9740 - DNA, 27 bp, Artificial Sequence
  Synthetic oligonucleotide
caaatggctatcagaagagcagaggta

SEQ ID NO: 9741 - DNA, 27 bp, Artificial Sequence
  Synthetic oligonucleotide
aaatggctatcagaagagcagaggtat

SEQ ID NO: 9742 - DNA, 27 bp, Artificial Sequence
  Synthetic oligonucleotide
aatggctatcagaagagcagaggtatg

SEQ ID NO: 9743 - DNA, 27 bp, Artificial Sequence
  Synthetic oligonucleotide
atggctatcagaagagcagaggtatgg

SEQ ID NO: 9744 - DNA, 27 bp, Artificial Sequence
  Synthetic oligonucleotide
tggctatcagaagagcagaggtatgga

SEQ ID NO: 9745 - DNA, 27 bp, Artificial Sequence
  Synthetic oligonucleotide
ggctatcagaagagcagaggtatggag

SEQ ID NO: 9746 - DNA, 27 bp, Artificial Sequence
  Synthetic oligonucleotide
gctatcagaagagcagaggtatggagg

SEQ ID NO: 9747 - DNA, 27 bp, Artificial Sequence
  Synthetic oligonucleotide
ctatcagaagagcagaggtatggaggt

SEQ ID NO: 9748 - DNA, 27 bp, Artificial Sequence
  Synthetic oligonucleotide
tatcagaagagcagaggtatggaggtg

SEQ ID NO: 9749 - DNA, 27 bp, Artificial Sequence
  Synthetic oligonucleotide
atcagaagagcagaggtatggaggtgg

SEQ ID NO: 9750 - DNA, 27 bp, Artificial Sequence
  Synthetic oligonucleotide
tcagaagagcagaggtatggaggtggc

SEQ ID NO: 9751 - DNA, 27 bp, Artificial Sequence
  Synthetic oligonucleotide
gaagagcagaggtatggaggtggcttt

SEQ ID NO: 9752 - DNA, 27 bp, Artificial Sequence
  Synthetic oligonucleotide
aagagcagaggtatggaggtggctttt

SEQ ID NO: 9753 - DNA, 27 bp, Artificial Sequence
  Synthetic oligonucleotide
agagcagaggtatggaggtggctttta

SEQ ID NO: 9754 - DNA, 27 bp, Artificial Sequence
  Synthetic oligonucleotide
gagcagaggtatggaggtggcttttat

SEQ ID NO: 9755 - DNA, 27 bp, Artificial Sequence
  Synthetic oligonucleotide
agcagaggtatggaggtggcttttatt

SEQ ID NO: 9756 - DNA, 27 bp, Artificial Sequence
  Synthetic oligonucleotide
gcagaggtatggaggtggcttttattc

SEQ ID NO: 9757 - DNA, 27 bp, Artificial Sequence
  Synthetic oligonucleotide
cagaggtatggaggtggcttttattca

SEQ ID NO: 9758 - DNA, 27 bp, Artificial Sequence
  Synthetic oligonucleotide
agaggtatggaggtggcttttattcaa

SEQ ID NO: 9759 - DNA, 27 bp, Artificial Sequence
  Synthetic oligonucleotide
gaggtatggaggtggcttttattcaac

SEQ ID NO: 9760 - DNA, 27 bp, Artificial Sequence
  Synthetic oligonucleotide
aggtatggaggtggcttttattcaacc

SEQ ID NO: 9761 - DNA, 27 bp, Artificial Sequence
  Synthetic oligonucleotide
ggtatggaggtggcttttattcaaccc

SEQ ID NO: 9762 - DNA, 27 bp, Artificial Sequence
  Synthetic oligonucleotide
gtatggaggtggcttttattcaaccca

SEQ ID NO: 9763 - DNA, 27 bp, Artificial Sequence
  Synthetic oligonucleotide
tatggaggtggcttttattcaacccag

SEQ ID NO: 9764 - DNA, 27 bp, Artificial Sequence
  Synthetic oligonucleotide
atggaggtggcttttattcaacccagg

SEQ ID NO: 9765 - DNA, 27 bp, Artificial Sequence
  Synthetic oligonucleotide
tggaggtggcttttattcaacccagga

SEQ ID NO: 9766 - DNA, 27 bp, Artificial Sequence
  Synthetic oligonucleotide
ggaggtggcttttattcaacccaggac

SEQ ID NO: 9767 - DNA, 27 bp, Artificial Sequence
  Synthetic oligonucleotide
gaggtggcttttattcaacccaggaca

SEQ ID NO: 9768 - DNA, 27 bp, Artificial Sequence
  Synthetic oligonucleotide
aggtggcttttattcaacccaggacac

SEQ ID NO: 9769 - DNA, 27 bp, Artificial Sequence
  Synthetic oligonucleotide
ggaatattcactcctggttaaacaact

SEQ ID NO: 9770 - DNA, 27 bp, Artificial Sequence
  Synthetic oligonucleotide
gaatattcactcctggttaaacaactc

SEQ ID NO: 9771 - DNA, 27 bp, Artificial Sequence
  Synthetic oligonucleotide
aatattcactcctggttaaacaactcc

SEQ ID NO: 9772 - DNA, 27 bp, Artificial Sequence
  Synthetic oligonucleotide
atattcactcctggttaaacaactccg

SEQ ID NO: 9773 - DNA, 27 bp, Artificial Sequence
  Synthetic oligonucleotide
gccttacataattataaaatgacagac

SEQ ID NO: 9774 - DNA, 27 bp, Artificial Sequence
  Synthetic oligonucleotide
ccttacataattataaaatgacagaca

SEQ ID NO: 9775 - DNA, 27 bp, Artificial Sequence
  Synthetic oligonucleotide
cttacataattataaaatgacagacaa

SEQ ID NO: 9776 - DNA, 27 bp, Artificial Sequence
  Synthetic oligonucleotide
ttacataattataaaatgacagacaag

SEQ ID NO: 9777 - DNA, 27 bp, Artificial Sequence
  Synthetic oligonucleotide
tacataattataaaatgacagacaaga

SEQ ID NO: 9778 - DNA, 27 bp, Artificial Sequence
  Synthetic oligonucleotide
acataattataaaatgacagacaagaa

SEQ ID NO: 9779 - DNA, 27 bp, Artificial Sequence
  Synthetic oligonucleotide
cataattataaaatgacagacaagaat

SEQ ID NO: 9780 - DNA, 27 bp, Artificial Sequence
  Synthetic oligonucleotide
ataattataaaatgacagacaagaatt

SEQ ID NO: 9781 - DNA, 27 bp, Artificial Sequence
  Synthetic oligonucleotide
taattataaaatgacagacaagaattt

SEQ ID NO: 9782 - DNA, 27 bp, Artificial Sequence
  Synthetic oligonucleotide
aattataaaatgacagacaagaatttc

SEQ ID NO: 9783 - DNA, 27 bp, Artificial Sequence
  Synthetic oligonucleotide
attataaaatgacagacaagaatttcc

SEQ ID NO: 9784 - DNA, 27 bp, Artificial Sequence
  Synthetic oligonucleotide
ttataaaatgacagacaagaatttcct

SEQ ID NO: 9785 - DNA, 27 bp, Artificial Sequence
  Synthetic oligonucleotide
tataaaatgacagacaagaatttcctt

SEQ ID NO: 9786 - DNA, 27 bp, Artificial Sequence
  Synthetic oligonucleotide
ataaaatgacagacaagaatttccttg

SEQ ID NO: 9787 - DNA, 27 bp, Artificial Sequence
  Synthetic oligonucleotide
taaaatgacagacaagaatttccttgg

SEQ ID NO: 9788 - DNA, 27 bp, Artificial Sequence
  Synthetic oligonucleotide
aaaatgacagacaagaatttccttggg

SEQ ID NO: 9789 - DNA, 27 bp, Artificial Sequence
  Synthetic oligonucleotide
aaatgacagacaagaatttccttggga

SEQ ID NO: 9790 - DNA, 27 bp, Artificial Sequence
  Synthetic oligonucleotide
aatgacagacaagaatttccttgggag

SEQ ID NO: 9791 - DNA, 27 bp, Artificial Sequence
  Synthetic oligonucleotide
atgacagacaagaatttccttgggagg

SEQ ID NO: 9792 - DNA, 27 bp, Artificial Sequence
  Synthetic oligonucleotide
tgacagacaagaatttccttgggaggc

SEQ ID NO: 9793 - DNA, 27 bp, Artificial Sequence
  Synthetic oligonucleotide
gacagacaagaatttccttgggaggcc

SEQ ID NO: 9794 - DNA, 27 bp, Artificial Sequence
  Synthetic oligonucleotide
acagacaagaatttccttgggaggcca

SEQ ID NO: 9795 - DNA, 27 bp, Artificial Sequence
  Synthetic oligonucleotide
cagacaagaatttccttgggaggccag

SEQ ID NO: 9796 - DNA, 27 bp, Artificial Sequence
  Synthetic oligonucleotide
agacaagaatttccttgggaggccagt

SEQ ID NO: 9797 - DNA, 27 bp, Artificial Sequence
  Synthetic oligonucleotide
gacaagaatttccttgggaggccagta

SEQ ID NO: 9798 - DNA, 27 bp, Artificial Sequence
  Synthetic oligonucleotide
acaagaatttccttgggaggccagtag

SEQ ID NO: 9799 - DNA, 27 bp, Artificial Sequence
  Synthetic oligonucleotide
caagaatttccttgggaggccagtaga

SEQ ID NO: 9800 - DNA, 27 bp, Artificial Sequence
  Synthetic oligonucleotide
aagaatttccttgggaggccagtagag

SEQ ID NO: 9801 - DNA, 27 bp, Artificial Sequence
  Synthetic oligonucleotide
tccttgggaggccagtagaggtgcttc

SEQ ID NO: 9802 - DNA, 27 bp, Artificial Sequence
  Synthetic oligonucleotide
ttgggaggccagtagaggtgcttctca

SEQ ID NO: 9803 - DNA, 27 bp, Artificial Sequence
  Synthetic oligonucleotide
tgggaggccagtagaggtgcttctcaa

SEQ ID NO: 9804 - DNA, 27 bp, Artificial Sequence
  Synthetic oligonucleotide
gggaggccagtagaggtgcttctcaat

SEQ ID NO: 9805 - DNA, 27 bp, Artificial Sequence
  Synthetic oligonucleotide
ggaggccagtagaggtgcttctcaatg

SEQ ID NO: 9806 - DNA, 27 bp, Artificial Sequence
  Synthetic oligonucleotide
gaggccagtagaggtgcttctcaatga

SEQ ID NO: 9807 - DNA, 27 bp, Artificial Sequence
  Synthetic oligonucleotide
aggccagtagaggtgcttctcaatgat

SEQ ID NO: 9808 - DNA, 27 bp, Artificial Sequence
  Synthetic oligonucleotide
ggccagtagaggtgcttctcaatgatg

SEQ ID NO: 9809 - DNA, 27 bp, Artificial Sequence
  Synthetic oligonucleotide
gccagtagaggtgcttctcaatgatga

SEQ ID NO: 9810 - DNA, 27 bp, Artificial Sequence
  Synthetic oligonucleotide
ccagtagaggtgcttctcaatgatgac

SEQ ID NO: 9811 - DNA, 27 bp, Artificial Sequence
  Synthetic oligonucleotide
cagtagaggtgcttctcaatgatgacc

SEQ ID NO: 9812 - DNA, 27 bp, Artificial Sequence
  Synthetic oligonucleotide
agtagaggtgcttctcaatgatgacct

SEQ ID NO: 9813 - DNA, 27 bp, Artificial Sequence
  Synthetic oligonucleotide
gtagaggtgcttctcaatgatgacctc

SEQ ID NO: 9814 - DNA, 27 bp, Artificial Sequence
  Synthetic oligonucleotide
tagaggtgcttctcaatgatgacctca

SEQ ID NO: 9815 - DNA, 27 bp, Artificial Sequence
  Synthetic oligonucleotide
agaggtgcttctcaatgatgacctcat

SEQ ID NO: 9816 - DNA, 27 bp, Artificial Sequence
  Synthetic oligonucleotide
gaggtgcttctcaatgatgacctcatt

SEQ ID NO: 9817 - DNA, 27 bp, Artificial Sequence
  Synthetic oligonucleotide
aggtgcttctcaatgatgacctcattg

SEQ ID NO: 9818 - DNA, 27 bp, Artificial Sequence
  Synthetic oligonucleotide
ggtgcttctcaatgatgacctcattgt

SEQ ID NO: 9819 - DNA, 27 bp, Artificial Sequence
  Synthetic oligonucleotide
gtgcttctcaatgatgacctcattgtc

SEQ ID NO: 9820 - DNA, 27 bp, Artificial Sequence
  Synthetic oligonucleotide
cattgtcagtacaggatttggcagtgg

SEQ ID NO: 9821 - DNA, 27 bp, Artificial Sequence
  Synthetic oligonucleotide
attgtcagtacaggatttggcagtggc

SEQ ID NO: 9822 - DNA, 27 bp, Artificial Sequence
  Synthetic oligonucleotide
ttgtcagtacaggatttggcagtggct

SEQ ID NO: 9823 - DNA, 27 bp, Artificial Sequence
  Synthetic oligonucleotide
tgtcagtacaggatttggcagtggctt

SEQ ID NO: 9824 - DNA, 27 bp, Artificial Sequence
  Synthetic oligonucleotide
gtcagtacaggatttggcagtggcttg

SEQ ID NO: 9825 - DNA, 27 bp, Artificial Sequence
  Synthetic oligonucleotide
tcagtacaggatttggcagtggcttgg

SEQ ID NO: 9826 - DNA, 27 bp, Artificial Sequence
  Synthetic oligonucleotide
cagtacaggatttggcagtggcttggc

SEQ ID NO: 9827 - DNA, 27 bp, Artificial Sequence
  Synthetic oligonucleotide
agtacaggatttggcagtggcttggct

SEQ ID NO: 9828 - DNA, 27 bp, Artificial Sequence
  Synthetic oligonucleotide
gtacaggatttggcagtggcttggcta

SEQ ID NO: 9829 - DNA, 27 bp, Artificial Sequence
  Synthetic oligonucleotide
tacaggatttggcagtggcttggctac

SEQ ID NO: 9830 - DNA, 27 bp, Artificial Sequence
  Synthetic oligonucleotide
acaggatttggcagtggcttggctaca

SEQ ID NO: 9831 - DNA, 27 bp, Artificial Sequence
  Synthetic oligonucleotide
aggatttggcagtggcttggctacagt

SEQ ID NO: 9832 - DNA, 27 bp, Artificial Sequence
  Synthetic oligonucleotide
ggatttggcagtggcttggctacagta

SEQ ID NO: 9833 - DNA, 27 bp, Artificial Sequence
  Synthetic oligonucleotide
gatttggcagtggcttggctacagtac

SEQ ID NO: 9834 - DNA, 27 bp, Artificial Sequence
  Synthetic oligonucleotide
atttggcagtggcttggctacagtaca

SEQ ID NO: 9835 - DNA, 27 bp, Artificial Sequence
  Synthetic oligonucleotide
cagtacatgtaacaactgtagttcaca

SEQ ID NO: 9836 - DNA, 27 bp, Artificial Sequence
  Synthetic oligonucleotide
agtacatgtaacaactgtagttcacaa

SEQ ID NO: 9837 - DNA, 27 bp, Artificial Sequence
  Synthetic oligonucleotide
gtacatgtaacaactgtagttcacaaa

SEQ ID NO: 9838 - DNA, 27 bp, Artificial Sequence
  Synthetic oligonucleotide
acatgtaacaactgtagttcacaaaac

SEQ ID NO: 9839 - DNA, 27 bp, Artificial Sequence
  Synthetic oligonucleotide
catgtaacaactgtagttcacaaaacc

SEQ ID NO: 9840 - DNA, 27 bp, Artificial Sequence
  Synthetic oligonucleotide
atgtaacaactgtagttcacaaaacca

SEQ ID NO: 9841 - DNA, 27 bp, Artificial Sequence
  Synthetic oligonucleotide
tgtaacaactgtagttcacaaaaccag

SEQ ID NO: 9842 - DNA, 27 bp, Artificial Sequence
  Synthetic oligonucleotide
gtaacaactgtagttcacaaaaccagt

SEQ ID NO: 9843 - DNA, 27 bp, Artificial Sequence
  Synthetic oligonucleotide
taacaactgtagttcacaaaaccagta

SEQ ID NO: 9844 - DNA, 27 bp, Artificial Sequence
  Synthetic oligonucleotide
aacaactgtagttcacaaaaccagtac

SEQ ID NO: 9845 - DNA, 27 bp, Artificial Sequence
  Synthetic oligonucleotide
acaactgtagttcacaaaaccagtacc

SEQ ID NO: 9846 - DNA, 27 bp, Artificial Sequence
  Synthetic oligonucleotide
caactgtagttcacaaaaccagtacct

SEQ ID NO: 9847 - DNA, 27 bp, Artificial Sequence
  Synthetic oligonucleotide
aactgtagttcacaaaaccagtacctc

SEQ ID NO: 9848 - DNA, 27 bp, Artificial Sequence
  Synthetic oligonucleotide
actgtagttcacaaaaccagtacctct

SEQ ID NO: 9849 - DNA, 27 bp, Artificial Sequence
  Synthetic oligonucleotide
ctgtagttcacaaaaccagtacctctg

SEQ ID NO: 9850 - DNA, 27 bp, Artificial Sequence
  Synthetic oligonucleotide
tgtagttcacaaaaccagtacctctga

SEQ ID NO: 9851 - DNA, 27 bp, Artificial Sequence
  Synthetic oligonucleotide
gtagttcacaaaaccagtacctctgag

SEQ ID NO: 9852 - DNA, 27 bp, Artificial Sequence
  Synthetic oligonucleotide
tagttcacaaaaccagtacctctgagg

SEQ ID NO: 9853 - DNA, 27 bp, Artificial Sequence
  Synthetic oligonucleotide
agttcacaaaaccagtacctctgagga

SEQ ID NO: 9854 - DNA, 27 bp, Artificial Sequence
  Synthetic oligonucleotide
gttcacaaaaccagtacctctgaggaa

SEQ ID NO: 9855 - DNA, 27 bp, Artificial Sequence
  Synthetic oligonucleotide
ttcacaaaaccagtacctctgaggaag

SEQ ID NO: 9856 - DNA, 27 bp, Artificial Sequence
  Synthetic oligonucleotide
tcacaaaaccagtacctctgaggaagt

SEQ ID NO: 9857 - DNA, 27 bp, Artificial Sequence
  Synthetic oligonucleotide
cacaaaaccagtacctctgaggaagtt

SEQ ID NO: 9858 - DNA, 27 bp, Artificial Sequence
  Synthetic oligonucleotide
acaaaaccagtacctctgaggaagttt

SEQ ID NO: 9859 - DNA, 27 bp, Artificial Sequence
  Synthetic oligonucleotide
caaaaccagtacctctgaggaagtttg

SEQ ID NO: 9860 - DNA, 27 bp, Artificial Sequence
  Synthetic oligonucleotide
aaaaccagtacctctgaggaagtttgc

SEQ ID NO: 9861 - DNA, 27 bp, Artificial Sequence
  Synthetic oligonucleotide
aaaccagtacctctgaggaagtttgca

SEQ ID NO: 9862 - DNA, 27 bp, Artificial Sequence
  Synthetic oligonucleotide
aaccagtacctctgaggaagtttgcag

SEQ ID NO: 9863 - DNA, 27 bp, Artificial Sequence
  Synthetic oligonucleotide
accagtacctctgaggaagtttgcagc

SEQ ID NO: 9864 - DNA, 27 bp, Artificial Sequence
  Synthetic oligonucleotide
ccagtacctctgaggaagtttgcagct

SEQ ID NO: 9865 - DNA, 27 bp, Artificial Sequence
  Synthetic oligonucleotide
cagtacctctgaggaagtttgcagctt

SEQ ID NO: 9866 - DNA, 27 bp, Artificial Sequence
  Synthetic oligonucleotide
agtacctctgaggaagtttgcagcttt

SEQ ID NO: 9867 - DNA, 27 bp, Artificial Sequence
  Synthetic oligonucleotide
gtacctctgaggaagtttgcagctttt

SEQ ID NO: 9868 - DNA, 27 bp, Artificial Sequence
  Synthetic oligonucleotide
tacctctgaggaagtttgcagctttta

SEQ ID NO: 9869 - DNA, 27 bp, Artificial Sequence
  Synthetic oligonucleotide
acctctgaggaagtttgcagcttttat

SEQ ID NO: 9870 - DNA, 27 bp, Artificial Sequence
  Synthetic oligonucleotide
cctctgaggaagtttgcagcttttatt

SEQ ID NO: 9871 - DNA, 27 bp, Artificial Sequence
  Synthetic oligonucleotide
ctctgaggaagtttgcagcttttattt

SEQ ID NO: 9872 - DNA, 27 bp, Artificial Sequence
  Synthetic oligonucleotide
tctgaggaagtttgcagcttttatttg

SEQ ID NO: 9873 - DNA, 27 bp, Artificial Sequence
  Synthetic oligonucleotide
gtttgcagcttttatttgaaaatcgat

SEQ ID NO: 9874 - DNA, 27 bp, Artificial Sequence
  Synthetic oligonucleotide
tttgcagcttttatttgaaaatcgata

SEQ ID NO: 9875 - DNA, 27 bp, Artificial Sequence
  Synthetic oligonucleotide
tcgatactcaggatattgaagcatccc

SEQ ID NO: 9876 - DNA, 27 bp, Artificial Sequence
  Synthetic oligonucleotide
gatactcaggatattgaagcatcccac

SEQ ID NO: 9877 - DNA, 27 bp, Artificial Sequence
  Synthetic oligonucleotide
atactcaggatattgaagcatcccact

SEQ ID NO: 9878 - DNA, 27 bp, Artificial Sequence
  Synthetic oligonucleotide
tactcaggatattgaagcatcccacta

SEQ ID NO: 9879 - DNA, 27 bp, Artificial Sequence
  Synthetic oligonucleotide
actcaggatattgaagcatcccactac

SEQ ID NO: 9880 - DNA, 27 bp, Artificial Sequence
  Synthetic oligonucleotide
tcaggatattgaagcatcccactacag

SEQ ID NO: 9881 - DNA, 27 bp, Artificial Sequence
  Synthetic oligonucleotide
caggatattgaagcatcccactacaga

SEQ ID NO: 9882 - DNA, 27 bp, Artificial Sequence
  Synthetic oligonucleotide
aggatattgaagcatcccactacagag

SEQ ID NO: 9883 - DNA, 27 bp, Artificial Sequence
  Synthetic oligonucleotide
ggatattgaagcatcccactacagagg

SEQ ID NO: 9884 - DNA, 27 bp, Artificial Sequence
  Synthetic oligonucleotide
gatattgaagcatcccactacagaggc

SEQ ID NO: 9885 - DNA, 27 bp, Artificial Sequence
  Synthetic oligonucleotide
atattgaagcatcccactacagaggct

SEQ ID NO: 9886 - DNA, 27 bp, Artificial Sequence
  Synthetic oligonucleotide
tattgaagcatcccactacagaggcta

SEQ ID NO: 9887 - DNA, 27 bp, Artificial Sequence
  Synthetic oligonucleotide
attgaagcatcccactacagaggctac

SEQ ID NO: 9888 - DNA, 27 bp, Artificial Sequence
  Synthetic oligonucleotide
ttgaagcatcccactacagaggctacg

SEQ ID NO: 9889 - DNA, 27 bp, Artificial Sequence
  Synthetic oligonucleotide
tgaagcatcccactacagaggctacgg

SEQ ID NO: 9890 - DNA, 27 bp, Artificial Sequence
  Synthetic oligonucleotide
gaagcatcccactacagaggctacgga

SEQ ID NO: 9891 - DNA, 27 bp, Artificial Sequence
  Synthetic oligonucleotide
aagcatcccactacagaggctacggaa

SEQ ID NO: 9892 - DNA, 27 bp, Artificial Sequence
  Synthetic oligonucleotide
agcatcccactacagaggctacggaaa

SEQ ID NO: 9893 - DNA, 27 bp, Artificial Sequence
  Synthetic oligonucleotide
gcatcccactacagaggctacggaaac

SEQ ID NO: 9894 - DNA, 27 bp, Artificial Sequence
  Synthetic oligonucleotide
catcccactacagaggctacggaaact

SEQ ID NO: 9895 - DNA, 27 bp, Artificial Sequence
  Synthetic oligonucleotide
atcccactacagaggctacggaaactc

SEQ ID NO: 9896 - DNA, 27 bp, Artificial Sequence
  Synthetic oligonucleotide
tcccactacagaggctacggaaactct

SEQ ID NO: 9897 - DNA, 27 bp, Artificial Sequence
  Synthetic oligonucleotide
cccactacagaggctacggaaactctg

SEQ ID NO: 9898 - DNA, 27 bp, Artificial Sequence
  Synthetic oligonucleotide
ccactacagaggctacggaaactctga

SEQ ID NO: 9899 - DNA, 27 bp, Artificial Sequence
  Synthetic oligonucleotide
cactacagaggctacggaaactctgat

SEQ ID NO: 9900 - DNA, 27 bp, Artificial Sequence
  Synthetic oligonucleotide
actacagaggctacggaaactctgatt

SEQ ID NO: 9901 - DNA, 27 bp, Artificial Sequence
  Synthetic oligonucleotide
ctacagaggctacggaaactctgatta

SEQ ID NO: 9902 - DNA, 27 bp, Artificial Sequence
  Synthetic oligonucleotide
tacagaggctacggaaactctgattac

SEQ ID NO: 9903 - DNA, 27 bp, Artificial Sequence
  Synthetic oligonucleotide
acagaggctacggaaactctgattaca

SEQ ID NO: 9904 - DNA, 27 bp, Artificial Sequence
  Synthetic oligonucleotide
cagaggctacggaaactctgattacaa

SEQ ID NO: 9905 - DNA, 27 bp, Artificial Sequence
  Synthetic oligonucleotide
agaggctacggaaactctgattacaaa

SEQ ID NO: 9906 - DNA, 27 bp, Artificial Sequence
  Synthetic oligonucleotide
gaggctacggaaactctgattacaaac

SEQ ID NO: 9907 - DNA, 27 bp, Artificial Sequence
  Synthetic oligonucleotide
aggctacggaaactctgattacaaacg

SEQ ID NO: 9908 - DNA, 27 bp, Artificial Sequence
  Synthetic oligonucleotide
ggctacggaaactctgattacaaacgc

SEQ ID NO: 9909 - DNA, 27 bp, Artificial Sequence
  Synthetic oligonucleotide
gctacggaaactctgattacaaacgca

SEQ ID NO: 9910 - DNA, 27 bp, Artificial Sequence
  Synthetic oligonucleotide
ctacggaaactctgattacaaacgcat

SEQ ID NO: 9911 - DNA, 27 bp, Artificial Sequence
  Synthetic oligonucleotide
tacggaaactctgattacaaacgcata

SEQ ID NO: 9912 - DNA, 27 bp, Artificial Sequence
  Synthetic oligonucleotide
acggaaactctgattacaaacgcatag

SEQ ID NO: 9913 - DNA, 27 bp, Artificial Sequence
  Synthetic oligonucleotide
cggaaactctgattacaaacgcatagt

SEQ ID NO: 9914 - DNA, 27 bp, Artificial Sequence
  Synthetic oligonucleotide
ggaaactctgattacaaacgcatagta

SEQ ID NO: 9915 - DNA, 27 bp, Artificial Sequence
  Synthetic oligonucleotide
gaaactctgattacaaacgcatagtag

SEQ ID NO: 9916 - DNA, 27 bp, Artificial Sequence
  Synthetic oligonucleotide
aaactctgattacaaacgcatagtagc

SEQ ID NO: 9917 - DNA, 27 bp, Artificial Sequence
  Synthetic oligonucleotide
aactctgattacaaacgcatagtagca

SEQ ID NO: 9918 - DNA, 27 bp, Artificial Sequence
  Synthetic oligonucleotide
actctgattacaaacgcatagtagcat

SEQ ID NO: 9919 - DNA, 27 bp, Artificial Sequence
  Synthetic oligonucleotide
ctctgattacaaacgcatagtagcatg

SEQ ID NO: 9920 - DNA, 27 bp, Artificial Sequence
  Synthetic oligonucleotide
tctgattacaaacgcatagtagcatgt

SEQ ID NO: 9921 - DNA, 27 bp, Artificial Sequence
  Synthetic oligonucleotide
ctgattacaaacgcatagtagcatgtg

SEQ ID NO: 9922 - DNA, 27 bp, Artificial Sequence
  Synthetic oligonucleotide
tgattacaaacgcatagtagcatgtgc

SEQ ID NO: 9923 - DNA, 27 bp, Artificial Sequence
  Synthetic oligonucleotide
gattacaaacgcatagtagcatgtgcc

SEQ ID NO: 9924 - DNA, 27 bp, Artificial Sequence
  Synthetic oligonucleotide
attacaaacgcatagtagcatgtgcca

SEQ ID NO: 9925 - DNA, 27 bp, Artificial Sequence
  Synthetic oligonucleotide
ttacaaacgcatagtagcatgtgccag

SEQ ID NO: 9926 - DNA, 27 bp, Artificial Sequence
  Synthetic oligonucleotide
tacaaacgcatagtagcatgtgccagc

SEQ ID NO: 9927 - DNA, 27 bp, Artificial Sequence
  Synthetic oligonucleotide
acaaacgcatagtagcatgtgccagct

SEQ ID NO: 9928 - DNA, 27 bp, Artificial Sequence
  Synthetic oligonucleotide
caaacgcatagtagcatgtgccagcta

SEQ ID NO: 9929 - DNA, 27 bp, Artificial Sequence
  Synthetic oligonucleotide
aaacgcatagtagcatgtgccagctac

SEQ ID NO: 9930 - DNA, 27 bp, Artificial Sequence
  Synthetic oligonucleotide
aacgcatagtagcatgtgccagctaca

SEQ ID NO: 9931 - DNA, 27 bp, Artificial Sequence
  Synthetic oligonucleotide
acgcatagtagcatgtgccagctacaa

SEQ ID NO: 9932 - DNA, 27 bp, Artificial Sequence
  Synthetic oligonucleotide
cgcatagtagcatgtgccagctacaag

SEQ ID NO: 9933 - DNA, 27 bp, Artificial Sequence
  Synthetic oligonucleotide
gcatagtagcatgtgccagctacaagc

SEQ ID NO: 9934 - DNA, 27 bp, Artificial Sequence
  Synthetic oligonucleotide
catagtagcatgtgccagctacaagcc

SEQ ID NO: 9935 - DNA, 27 bp, Artificial Sequence
  Synthetic oligonucleotide
atagtagcatgtgccagctacaagccc

SEQ ID NO: 9936 - DNA, 27 bp, Artificial Sequence
  Synthetic oligonucleotide
tagtagcatgtgccagctacaagccca

SEQ ID NO: 9937 - DNA, 27 bp, Artificial Sequence
  Synthetic oligonucleotide
cggtgatggacatctccttgcctactg

SEQ ID NO: 9938 - DNA, 27 bp, Artificial Sequence
  Synthetic oligonucleotide
ggtgatggacatctccttgcctactgg

SEQ ID NO: 9939 - DNA, 27 bp, Artificial Sequence
  Synthetic oligonucleotide
gtgatggacatctccttgcctactgga

SEQ ID NO: 9940 - DNA, 27 bp, Artificial Sequence
  Synthetic oligonucleotide
tgatggacatctccttgcctactggaa

SEQ ID NO: 9941 - DNA, 27 bp, Artificial Sequence
  Synthetic oligonucleotide
gatggacatctccttgcctactggaat

SEQ ID NO: 9942 - DNA, 27 bp, Artificial Sequence
  Synthetic oligonucleotide
atggacatctccttgcctactggaatc

SEQ ID NO: 9943 - DNA, 27 bp, Artificial Sequence
  Synthetic oligonucleotide
tggacatctccttgcctactggaatca

SEQ ID NO: 9944 - DNA, 27 bp, Artificial Sequence
  Synthetic oligonucleotide
ggacatctccttgcctactggaatcag

SEQ ID NO: 9945 - DNA, 27 bp, Artificial Sequence
  Synthetic oligonucleotide
gacatctccttgcctactggaatcagt

SEQ ID NO: 9946 - DNA, 27 bp, Artificial Sequence
  Synthetic oligonucleotide
acatctccttgcctactggaatcagtg

SEQ ID NO: 9947 - DNA, 27 bp, Artificial Sequence
  Synthetic oligonucleotide
catctccttgcctactggaatcagtgc

SEQ ID NO: 9948 - DNA, 27 bp, Artificial Sequence
  Synthetic oligonucleotide
atctccttgcctactggaatcagtgca

SEQ ID NO: 9949 - DNA, 27 bp, Artificial Sequence
  Synthetic oligonucleotide
tctccttgcctactggaatcagtgcaa

SEQ ID NO: 9950 - DNA, 27 bp, Artificial Sequence
  Synthetic oligonucleotide
agtgcaaatgaagaagacttaaaagcc

SEQ ID NO: 9951 - DNA, 27 bp, Artificial Sequence
  Synthetic oligonucleotide
gtgcaaatgaagaagacttaaaagccc

SEQ ID NO: 9952 - DNA, 27 bp, Artificial Sequence
  Synthetic oligonucleotide
tgcaaatgaagaagacttaaaagccct

SEQ ID NO: 9953 - DNA, 27 bp, Artificial Sequence
  Synthetic oligonucleotide
gcaaatgaagaagacttaaaagccctt

SEQ ID NO: 9954 - DNA, 27 bp, Artificial Sequence
  Synthetic oligonucleotide
caaatgaagaagacttaaaagcccttg

SEQ ID NO: 9955 - DNA, 27 bp, Artificial Sequence
  Synthetic oligonucleotide
aaatgaagaagacttaaaagcccttgt

SEQ ID NO: 9956 - DNA, 27 bp, Artificial Sequence
  Synthetic oligonucleotide
cccttgtggaaggggtggatcaactat

SEQ ID NO: 9957 - DNA, 27 bp, Artificial Sequence
  Synthetic oligonucleotide
ccttgtggaaggggtggatcaactatt

SEQ ID NO: 9958 - DNA, 27 bp, Artificial Sequence
  Synthetic oligonucleotide
aactattcactgattaccaaatcaaag

SEQ ID NO: 9959 - DNA, 27 bp, Artificial Sequence
  Synthetic oligonucleotide
actattcactgattaccaaatcaaaga

SEQ ID NO: 9960 - DNA, 27 bp, Artificial Sequence
  Synthetic oligonucleotide
tcaaagatggacatgttattctgcaac

SEQ ID NO: 9961 - DNA, 27 bp, Artificial Sequence
  Synthetic oligonucleotide
caaagatggacatgttattctgcaact

SEQ ID NO: 9962 - DNA, 27 bp, Artificial Sequence
  Synthetic oligonucleotide
aaagatggacatgttattctgcaactg

SEQ ID NO: 9963 - DNA, 27 bp, Artificial Sequence
  Synthetic oligonucleotide
gatggacatgttattctgcaactgaat

SEQ ID NO: 9964 - DNA, 27 bp, Artificial Sequence
  Synthetic oligonucleotide
tggacatgttattctgcaactgaattc

SEQ ID NO: 9965 - DNA, 27 bp, Artificial Sequence
  Synthetic oligonucleotide
catgttattctgcaactgaattcgatt

SEQ ID NO: 9966 - DNA, 27 bp, Artificial Sequence
  Synthetic oligonucleotide
atgttattctgcaactgaattcgattc

SEQ ID NO: 9967 - DNA, 27 bp, Artificial Sequence
  Synthetic oligonucleotide
tgttattctgcaactgaattcgattcc

SEQ ID NO: 9968 - DNA, 27 bp, Artificial Sequence
  Synthetic oligonucleotide
gttattctgcaactgaattcgattccc

SEQ ID NO: 9969 - DNA, 27 bp, Artificial Sequence
  Synthetic oligonucleotide
tatttgaactctttgaagttgggtttc

SEQ ID NO: 9970 - DNA, 27 bp, Artificial Sequence
  Synthetic oligonucleotide
atttgaactctttgaagttgggtttct

SEQ ID NO: 9971 - DNA, 27 bp, Artificial Sequence
  Synthetic oligonucleotide
tttgaactctttgaagttgggtttctc

SEQ ID NO: 9972 - DNA, 27 bp, Artificial Sequence
  Synthetic oligonucleotide
ttgaactctttgaagttgggtttctca

SEQ ID NO: 9973 - DNA, 27 bp, Artificial Sequence
  Synthetic oligonucleotide
tgaactctttgaagttgggtttctcag

SEQ ID NO: 9974 - DNA, 27 bp, Artificial Sequence
  Synthetic oligonucleotide
gaactctttgaagttgggtttctcagt

SEQ ID NO: 9975 - DNA, 27 bp, Artificial Sequence
  Synthetic oligonucleotide
aactctttgaagttgggtttctcagtc

SEQ ID NO: 9976 - DNA, 27 bp, Artificial Sequence
  Synthetic oligonucleotide
actctttgaagttgggtttctcagtcc

SEQ ID NO: 9977 - DNA, 27 bp, Artificial Sequence
  Synthetic oligonucleotide
tcagtcctgccactttcacagtgtacg

SEQ ID NO: 9978 - DNA, 27 bp, Artificial Sequence
  Synthetic oligonucleotide
cagtcctgccactttcacagtgtacga

SEQ ID NO: 9979 - DNA, 27 bp, Artificial Sequence
  Synthetic oligonucleotide
agtcctgccactttcacagtgtacgaa

SEQ ID NO: 9980 - DNA, 27 bp, Artificial Sequence
  Synthetic oligonucleotide
gtcctgccactttcacagtgtacgaat

SEQ ID NO: 9981 - DNA, 27 bp, Artificial Sequence
  Synthetic oligonucleotide
tcctgccactttcacagtgtacgaata

SEQ ID NO: 9982 - DNA, 27 bp, Artificial Sequence
  Synthetic oligonucleotide
acgaataccacagaccagataaacagt

SEQ ID NO: 9983 - DNA, 27 bp, Artificial Sequence
  Synthetic oligonucleotide
cgaataccacagaccagataaacagtg

SEQ ID NO: 9984 - DNA, 27 bp, Artificial Sequence
  Synthetic oligonucleotide
gaataccacagaccagataaacagtgt

SEQ ID NO: 9985 - DNA, 27 bp, Artificial Sequence
  Synthetic oligonucleotide
aataccacagaccagataaacagtgta

SEQ ID NO: 9986 - DNA, 27 bp, Artificial Sequence
  Synthetic oligonucleotide
ataccacagaccagataaacagtgtac

SEQ ID NO: 9987 - DNA, 27 bp, Artificial Sequence
  Synthetic oligonucleotide
taccacagaccagataaacagtgtacc

SEQ ID NO: 9988 - DNA, 27 bp, Artificial Sequence
  Synthetic oligonucleotide
accacagaccagataaacagtgtacca

SEQ ID NO: 9989 - DNA, 27 bp, Artificial Sequence
  Synthetic oligonucleotide
ccacagaccagataaacagtgtaccat

SEQ ID NO: 9990 - DNA, 27 bp, Artificial Sequence
  Synthetic oligonucleotide
cacagaccagataaacagtgtaccatg

SEQ ID NO: 9991 - DNA, 27 bp, Artificial Sequence
  Synthetic oligonucleotide
acagaccagataaacagtgtaccatgt

SEQ ID NO: 9992 - DNA, 27 bp, Artificial Sequence
  Synthetic oligonucleotide
cagaccagataaacagtgtaccatgtt

SEQ ID NO: 9993 - DNA, 27 bp, Artificial Sequence
  Synthetic oligonucleotide
agaccagataaacagtgtaccatgttt

SEQ ID NO: 9994 - DNA, 27 bp, Artificial Sequence
  Synthetic oligonucleotide
gaccagataaacagtgtaccatgtttt

SEQ ID NO: 9995 - DNA, 27 bp, Artificial Sequence
  Synthetic oligonucleotide
accagataaacagtgtaccatgtttta

SEQ ID NO: 9996 - DNA, 27 bp, Artificial Sequence
  Synthetic oligonucleotide
ccagataaacagtgtaccatgttttat

SEQ ID NO: 9997 - DNA, 27 bp, Artificial Sequence
  Synthetic oligonucleotide
gataaacagtgtaccatgttttatagc

SEQ ID NO: 9998 - DNA, 27 bp, Artificial Sequence
  Synthetic oligonucleotide
taaacagtgtaccatgttttatagcac

SEQ ID NO: 9999 - DNA, 27 bp, Artificial Sequence
  Synthetic oligonucleotide
aacagtgtaccatgttttatagcactt

SEQ ID NO: 10000 - DNA, 27 bp, Artificial Sequence
  Synthetic oligonucleotide
acagtgtaccatgttttatagcacttc

SEQ ID NO: 10001 - DNA, 27 bp, Artificial Sequence
  Synthetic oligonucleotide
cagtgtaccatgttttatagcacttcc

SEQ ID NO: 10002 - DNA, 27 bp, Artificial Sequence
  Synthetic oligonucleotide
agtgtaccatgttttatagcacttcca

SEQ ID NO: 10003 - DNA, 27 bp, Artificial Sequence
  Synthetic oligonucleotide
gtgtaccatgttttatagcacttccaa

SEQ ID NO: 10004 - DNA, 27 bp, Artificial Sequence
  Synthetic oligonucleotide
tgtaccatgttttatagcacttccaat

SEQ ID NO: 10005 - DNA, 27 bp, Artificial Sequence
  Synthetic oligonucleotide
gtaccatgttttatagcacttccaata

SEQ ID NO: 10006 - DNA, 27 bp, Artificial Sequence
  Synthetic oligonucleotide
taccatgttttatagcacttccaatat

SEQ ID NO: 10007 - DNA, 27 bp, Artificial Sequence
  Synthetic oligonucleotide
accatgttttatagcacttccaatatc

SEQ ID NO: 10008 - DNA, 27 bp, Artificial Sequence
  Synthetic oligonucleotide
ccatgttttatagcacttccaatatca

SEQ ID NO: 10009 - DNA, 27 bp, Artificial Sequence
  Synthetic oligonucleotide
catgttttatagcacttccaatatcaa

SEQ ID NO: 10010 - DNA, 27 bp, Artificial Sequence
  Synthetic oligonucleotide
atgttttatagcacttccaatatcaaa

SEQ ID NO: 10011 - DNA, 27 bp, Artificial Sequence
  Synthetic oligonucleotide
tgttttatagcacttccaatatcaaaa

SEQ ID NO: 10012 - DNA, 27 bp, Artificial Sequence
  Synthetic oligonucleotide
gttttatagcacttccaatatcaaaat

SEQ ID NO: 10013 - DNA, 27 bp, Artificial Sequence
  Synthetic oligonucleotide
ttttatagcacttccaatatcaaaatt

SEQ ID NO: 10014 - DNA, 27 bp, Artificial Sequence
  Synthetic oligonucleotide
tttatagcacttccaatatcaaaattc

SEQ ID NO: 10015 - DNA, 27 bp, Artificial Sequence
  Synthetic oligonucleotide
tatagcacttccaatatcaaaattcag

SEQ ID NO: 10016 - DNA, 27 bp, Artificial Sequence
  Synthetic oligonucleotide
atagcacttccaatatcaaaattcaga

SEQ ID NO: 10017 - DNA, 27 bp, Artificial Sequence
  Synthetic oligonucleotide
tagcacttccaatatcaaaattcagaa

SEQ ID NO: 10018 - DNA, 27 bp, Artificial Sequence
  Synthetic oligonucleotide
agcacttccaatatcaaaattcagaaa

SEQ ID NO: 10019 - DNA, 27 bp, Artificial Sequence
  Synthetic oligonucleotide
gcacttccaatatcaaaattcagaaag

SEQ ID NO: 10020 - DNA, 27 bp, Artificial Sequence
  Synthetic oligonucleotide
cacttccaatatcaaaattcagaaagt

SEQ ID NO: 10021 - DNA, 27 bp, Artificial Sequence
  Synthetic oligonucleotide
acttccaatatcaaaattcagaaagtc

SEQ ID NO: 10022 - DNA, 27 bp, Artificial Sequence
  Synthetic oligonucleotide
cttccaatatcaaaattcagaaagtct

SEQ ID NO: 10023 - DNA, 27 bp, Artificial Sequence
  Synthetic oligonucleotide
ttccaatatcaaaattcagaaagtctg

SEQ ID NO: 10024 - DNA, 27 bp, Artificial Sequence
  Synthetic oligonucleotide
tccaatatcaaaattcagaaagtctgt

SEQ ID NO: 10025 - DNA, 27 bp, Artificial Sequence
  Synthetic oligonucleotide
ccaatatcaaaattcagaaagtctgtg

SEQ ID NO: 10026 - DNA, 27 bp, Artificial Sequence
  Synthetic oligonucleotide
caatatcaaaattcagaaagtctgtga

SEQ ID NO: 10027 - DNA, 27 bp, Artificial Sequence
  Synthetic oligonucleotide
aatatcaaaattcagaaagtctgtgaa

SEQ ID NO: 10028 - DNA, 27 bp, Artificial Sequence
  Synthetic oligonucleotide
atatcaaaattcagaaagtctgtgaag

SEQ ID NO: 10029 - DNA, 27 bp, Artificial Sequence
  Synthetic oligonucleotide
tatcaaaattcagaaagtctgtgaagg

SEQ ID NO: 10030 - DNA, 27 bp, Artificial Sequence
  Synthetic oligonucleotide
atcaaaattcagaaagtctgtgaagga

SEQ ID NO: 10031 - DNA, 27 bp, Artificial Sequence
  Synthetic oligonucleotide
tcaaaattcagaaagtctgtgaaggag

SEQ ID NO: 10032 - DNA, 27 bp, Artificial Sequence
  Synthetic oligonucleotide
caaaattcagaaagtctgtgaaggagc

SEQ ID NO: 10033 - DNA, 27 bp, Artificial Sequence
  Synthetic oligonucleotide
aaaattcagaaagtctgtgaaggagcc

SEQ ID NO: 10034 - DNA, 27 bp, Artificial Sequence
  Synthetic oligonucleotide
aaattcagaaagtctgtgaaggagccg

SEQ ID NO: 10035 - DNA, 27 bp, Artificial Sequence
  Synthetic oligonucleotide
cagaaagtctgtgaaggagccgcgtgc

SEQ ID NO: 10036 - DNA, 27 bp, Artificial Sequence
  Synthetic oligonucleotide
tgtagaagctgattgtgggcaaatgca

SEQ ID NO: 10037 - DNA, 27 bp, Artificial Sequence
  Synthetic oligonucleotide
gtagaagctgattgtgggcaaatgcag

SEQ ID NO: 10038 - DNA, 27 bp, Artificial Sequence
  Synthetic oligonucleotide
tagaagctgattgtgggcaaatgcagg

SEQ ID NO: 10039 - DNA, 27 bp, Artificial Sequence
  Synthetic oligonucleotide
agaagctgattgtgggcaaatgcagga

SEQ ID NO: 10040 - DNA, 27 bp, Artificial Sequence
  Synthetic oligonucleotide
gaagctgattgtgggcaaatgcaggaa

SEQ ID NO: 10041 - DNA, 27 bp, Artificial Sequence
  Synthetic oligonucleotide
aagctgattgtgggcaaatgcaggaag

SEQ ID NO: 10042 - DNA, 27 bp, Artificial Sequence
  Synthetic oligonucleotide
agctgattgtgggcaaatgcaggaaga

SEQ ID NO: 10043 - DNA, 27 bp, Artificial Sequence
  Synthetic oligonucleotide
gctgattgtgggcaaatgcaggaagaa

SEQ ID NO: 10044 - DNA, 27 bp, Artificial Sequence
  Synthetic oligonucleotide
ggaagaattggatctgacaatctctgc

SEQ ID NO: 10045 - DNA, 27 bp, Artificial Sequence
  Synthetic oligonucleotide
gaagaattggatctgacaatctctgca

SEQ ID NO: 10046 - DNA, 27 bp, Artificial Sequence
  Synthetic oligonucleotide
aagaattggatctgacaatctctgcag

SEQ ID NO: 10047 - DNA, 27 bp, Artificial Sequence
  Synthetic oligonucleotide
agaattggatctgacaatctctgcaga

SEQ ID NO: 10048 - DNA, 27 bp, Artificial Sequence
  Synthetic oligonucleotide
gaattggatctgacaatctctgcagag

SEQ ID NO: 10049 - DNA, 27 bp, Artificial Sequence
  Synthetic oligonucleotide
aattggatctgacaatctctgcagaga

SEQ ID NO: 10050 - DNA, 27 bp, Artificial Sequence
  Synthetic oligonucleotide
attggatctgacaatctctgcagagac

SEQ ID NO: 10051 - DNA, 27 bp, Artificial Sequence
  Synthetic oligonucleotide
ttggatctgacaatctctgcagagaca

SEQ ID NO: 10052 - DNA, 27 bp, Artificial Sequence
  Synthetic oligonucleotide
tggatctgacaatctctgcagagacaa

SEQ ID NO: 10053 - DNA, 27 bp, Artificial Sequence
  Synthetic oligonucleotide
ggatctgacaatctctgcagagacaag

SEQ ID NO: 10054 - DNA, 27 bp, Artificial Sequence
  Synthetic oligonucleotide
gatctgacaatctctgcagagacaaga

SEQ ID NO: 10055 - DNA, 27 bp, Artificial Sequence
  Synthetic oligonucleotide
atctgacaatctctgcagagacaagaa

SEQ ID NO: 10056 - DNA, 27 bp, Artificial Sequence
  Synthetic oligonucleotide
tctgacaatctctgcagagacaagaaa

SEQ ID NO: 10057 - DNA, 27 bp, Artificial Sequence
  Synthetic oligonucleotide
caagaaaacaaacagcatgtaaaccag

SEQ ID NO: 10058 - DNA, 27 bp, Artificial Sequence
  Synthetic oligonucleotide
aagaaaacaaacagcatgtaaaccaga

SEQ ID NO: 10059 - DNA, 27 bp, Artificial Sequence
  Synthetic oligonucleotide
gagattgcatatgcttataaagttagc

SEQ ID NO: 10060 - DNA, 27 bp, Artificial Sequence
  Synthetic oligonucleotide
agattgcatatgcttataaagttagca

SEQ ID NO: 10061 - DNA, 27 bp, Artificial Sequence
  Synthetic oligonucleotide
gattgcatatgcttataaagttagcat

SEQ ID NO: 10062 - DNA, 27 bp, Artificial Sequence
  Synthetic oligonucleotide
attgcatatgcttataaagttagcatc

SEQ ID NO: 10063 - DNA, 27 bp, Artificial Sequence
  Synthetic oligonucleotide
ttgcatatgcttataaagttagcatca

SEQ ID NO: 10064 - DNA, 27 bp, Artificial Sequence
  Synthetic oligonucleotide
aaatgtttttgtcaagtacaaggcaac

SEQ ID NO: 10065 - DNA, 27 bp, Artificial Sequence
  Synthetic oligonucleotide
aatgtttttgtcaagtacaaggcaacc

SEQ ID NO: 10066 - DNA, 27 bp, Artificial Sequence
  Synthetic oligonucleotide
atgtttttgtcaagtacaaggcaaccc

SEQ ID NO: 10067 - DNA, 27 bp, Artificial Sequence
  Synthetic oligonucleotide
tgtttttgtcaagtacaaggcaaccct

SEQ ID NO: 10068 - DNA, 27 bp, Artificial Sequence
  Synthetic oligonucleotide
gtttttgtcaagtacaaggcaaccctt

SEQ ID NO: 10069 - DNA, 27 bp, Artificial Sequence
  Synthetic oligonucleotide
tttttgtcaagtacaaggcaacccttc

SEQ ID NO: 10070 - DNA, 27 bp, Artificial Sequence
  Synthetic oligonucleotide
ttttgtcaagtacaaggcaacccttct

SEQ ID NO: 10071 - DNA, 27 bp, Artificial Sequence
  Synthetic oligonucleotide
tttgtcaagtacaaggcaacccttctg

SEQ ID NO: 10072 - DNA, 27 bp, Artificial Sequence
  Synthetic oligonucleotide
ttgtcaagtacaaggcaacccttctgg

SEQ ID NO: 10073 - DNA, 27 bp, Artificial Sequence
  Synthetic oligonucleotide
tgtcaagtacaaggcaacccttctgga

SEQ ID NO: 10074 - DNA, 27 bp, Artificial Sequence
  Synthetic oligonucleotide
gtcaagtacaaggcaacccttctggat

SEQ ID NO: 10075 - DNA, 27 bp, Artificial Sequence
  Synthetic oligonucleotide
tcaagtacaaggcaacccttctggata

SEQ ID NO: 10076 - DNA, 27 bp, Artificial Sequence
  Synthetic oligonucleotide
caagtacaaggcaacccttctggatat

SEQ ID NO: 10077 - DNA, 27 bp, Artificial Sequence
  Synthetic oligonucleotide
aagtacaaggcaacccttctggatatc

SEQ ID NO: 10078 - DNA, 27 bp, Artificial Sequence
  Synthetic oligonucleotide
agtacaaggcaacccttctggatatct

SEQ ID NO: 10079 - DNA, 27 bp, Artificial Sequence
  Synthetic oligonucleotide
gtacaaggcaacccttctggatatcta

SEQ ID NO: 10080 - DNA, 27 bp, Artificial Sequence
  Synthetic oligonucleotide
tacaaggcaacccttctggatatctac

SEQ ID NO: 10081 - DNA, 27 bp, Artificial Sequence
  Synthetic oligonucleotide
acaaggcaacccttctggatatctaca

SEQ ID NO: 10082 - DNA, 27 bp, Artificial Sequence
  Synthetic oligonucleotide
caaggcaacccttctggatatctacaa

SEQ ID NO: 10083 - DNA, 27 bp, Artificial Sequence
  Synthetic oligonucleotide
aaggcaacccttctggatatctacaaa

SEQ ID NO: 10084 - DNA, 27 bp, Artificial Sequence
  Synthetic oligonucleotide
aggcaacccttctggatatctacaaaa

SEQ ID NO: 10085 - DNA, 27 bp, Artificial Sequence
  Synthetic oligonucleotide
ggcaacccttctggatatctacaaaac

SEQ ID NO: 10086 - DNA, 27 bp, Artificial Sequence
  Synthetic oligonucleotide
gcaacccttctggatatctacaaaact

SEQ ID NO: 10087 - DNA, 27 bp, Artificial Sequence
  Synthetic oligonucleotide
caacccttctggatatctacaaaactg

SEQ ID NO: 10088 - DNA, 27 bp, Artificial Sequence
  Synthetic oligonucleotide
aacccttctggatatctacaaaactgg

SEQ ID NO: 10089 - DNA, 27 bp, Artificial Sequence
  Synthetic oligonucleotide
acccttctggatatctacaaaactggg

SEQ ID NO: 10090 - DNA, 27 bp, Artificial Sequence
  Synthetic oligonucleotide
cccttctggatatctacaaaactgggg

SEQ ID NO: 10091 - DNA, 27 bp, Artificial Sequence
  Synthetic oligonucleotide
ccttctggatatctacaaaactgggga

SEQ ID NO: 10092 - DNA, 27 bp, Artificial Sequence
  Synthetic oligonucleotide
cttctggatatctacaaaactggggaa

SEQ ID NO: 10093 - DNA, 27 bp, Artificial Sequence
  Synthetic oligonucleotide
ttctggatatctacaaaactggggaag

SEQ ID NO: 10094 - DNA, 27 bp, Artificial Sequence
  Synthetic oligonucleotide
tctggatatctacaaaactggggaagc

SEQ ID NO: 10095 - DNA, 27 bp, Artificial Sequence
  Synthetic oligonucleotide
ctggatatctacaaaactggggaagct

SEQ ID NO: 10096 - DNA, 27 bp, Artificial Sequence
  Synthetic oligonucleotide
tggatatctacaaaactggggaagctg

SEQ ID NO: 10097 - DNA, 27 bp, Artificial Sequence
  Synthetic oligonucleotide
ggatatctacaaaactggggaagctgt

SEQ ID NO: 10098 - DNA, 27 bp, Artificial Sequence
  Synthetic oligonucleotide
gatatctacaaaactggggaagctgtt

SEQ ID NO: 10099 - DNA, 27 bp, Artificial Sequence
  Synthetic oligonucleotide
atatctacaaaactggggaagctgttg

SEQ ID NO: 10100 - DNA, 27 bp, Artificial Sequence
  Synthetic oligonucleotide
tatctacaaaactggggaagctgttgc

SEQ ID NO: 10101 - DNA, 27 bp, Artificial Sequence
  Synthetic oligonucleotide
atctacaaaactggggaagctgttgct

SEQ ID NO: 10102 - DNA, 27 bp, Artificial Sequence
  Synthetic oligonucleotide
tctacaaaactggggaagctgttgctg

SEQ ID NO: 10103 - DNA, 27 bp, Artificial Sequence
  Synthetic oligonucleotide
ctacaaaactggggaagctgttgctga

SEQ ID NO: 10104 - DNA, 27 bp, Artificial Sequence
  Synthetic oligonucleotide
tacaaaactggggaagctgttgctgag

SEQ ID NO: 10105 - DNA, 27 bp, Artificial Sequence
  Synthetic oligonucleotide
acaaaactggggaagctgttgctgaga

SEQ ID NO: 10106 - DNA, 27 bp, Artificial Sequence
  Synthetic oligonucleotide
caaaactggggaagctgttgctgagaa

SEQ ID NO: 10107 - DNA, 27 bp, Artificial Sequence
  Synthetic oligonucleotide
aaaactggggaagctgttgctgagaaa

SEQ ID NO: 10108 - DNA, 27 bp, Artificial Sequence
  Synthetic oligonucleotide
aaactggggaagctgttgctgagaaag

SEQ ID NO: 10109 - DNA, 27 bp, Artificial Sequence
  Synthetic oligonucleotide
aactggggaagctgttgctgagaaaga

SEQ ID NO: 10110 - DNA, 27 bp, Artificial Sequence
  Synthetic oligonucleotide
ttaccttcattaaaaaggtaacctgta

SEQ ID NO: 10111 - DNA, 27 bp, Artificial Sequence
  Synthetic oligonucleotide
taccttcattaaaaaggtaacctgtac

SEQ ID NO: 10112 - DNA, 27 bp, Artificial Sequence
  Synthetic oligonucleotide
accttcattaaaaaggtaacctgtact

SEQ ID NO: 10113 - DNA, 27 bp, Artificial Sequence
  Synthetic oligonucleotide
ccttcattaaaaaggtaacctgtacta

SEQ ID NO: 10114 - DNA, 27 bp, Artificial Sequence
  Synthetic oligonucleotide
cttcattaaaaaggtaacctgtactaa

SEQ ID NO: 10115 - DNA, 27 bp, Artificial Sequence
  Synthetic oligonucleotide
taaaaggaagacagtacttaattatgg

SEQ ID NO: 10116 - DNA, 27 bp, Artificial Sequence
  Synthetic oligonucleotide
aaaaggaagacagtacttaattatggg

SEQ ID NO: 10117 - DNA, 27 bp, Artificial Sequence
  Synthetic oligonucleotide
aaaggaagacagtacttaattatgggt

SEQ ID NO: 10118 - DNA, 27 bp, Artificial Sequence
  Synthetic oligonucleotide
aaggaagacagtacttaattatgggta

SEQ ID NO: 10119 - DNA, 27 bp, Artificial Sequence
  Synthetic oligonucleotide
aggaagacagtacttaattatgggtaa

SEQ ID NO: 10120 - DNA, 27 bp, Artificial Sequence
  Synthetic oligonucleotide
ggaagacagtacttaattatgggtaaa

SEQ ID NO: 10121 - DNA, 27 bp, Artificial Sequence
  Synthetic oligonucleotide
gaagacagtacttaattatgggtaaag

SEQ ID NO: 10122 - DNA, 27 bp, Artificial Sequence
  Synthetic oligonucleotide
aagacagtacttaattatgggtaaaga

SEQ ID NO: 10123 - DNA, 27 bp, Artificial Sequence
  Synthetic oligonucleotide
ccctccagataaaatacaatttcagtt

SEQ ID NO: 10124 - DNA, 27 bp, Artificial Sequence
  Synthetic oligonucleotide
cctccagataaaatacaatttcagttt

SEQ ID NO: 10125 - DNA, 27 bp, Artificial Sequence
  Synthetic oligonucleotide
tccagataaaatacaatttcagtttca

SEQ ID NO: 10126 - DNA, 27 bp, Artificial Sequence
  Synthetic oligonucleotide
agtttcaggtacatctaccctttagat

SEQ ID NO: 10127 - DNA, 27 bp, Artificial Sequence
  Synthetic oligonucleotide
gtttcaggtacatctaccctttagatt

SEQ ID NO: 10128 - DNA, 27 bp, Artificial Sequence
  Synthetic oligonucleotide
tttcaggtacatctaccctttagattc

SEQ ID NO: 10129 - DNA, 27 bp, Artificial Sequence
  Synthetic oligonucleotide
ttcaggtacatctaccctttagattcc

SEQ ID NO: 10130 - DNA, 27 bp, Artificial Sequence
  Synthetic oligonucleotide
tcaggtacatctaccctttagattcct

SEQ ID NO: 10131 - DNA, 27 bp, Artificial Sequence
  Synthetic oligonucleotide
caggtacatctaccctttagattcctt

SEQ ID NO: 10132 - DNA, 27 bp, Artificial Sequence
  Synthetic oligonucleotide
aggtacatctaccctttagattccttg

SEQ ID NO: 10133 - DNA, 27 bp, Artificial Sequence
  Synthetic oligonucleotide
ggtacatctaccctttagattccttga

SEQ ID NO: 10134 - DNA, 27 bp, Artificial Sequence
  Synthetic oligonucleotide
gtacatctaccctttagattccttgac

SEQ ID NO: 10135 - DNA, 27 bp, Artificial Sequence
  Synthetic oligonucleotide
tacatctaccctttagattccttgacc

SEQ ID NO: 10136 - DNA, 27 bp, Artificial Sequence
  Synthetic oligonucleotide
acatctaccctttagattccttgacct

SEQ ID NO: 10137 - DNA, 27 bp, Artificial Sequence
  Synthetic oligonucleotide
catctaccctttagattccttgacctg

SEQ ID NO: 10138 - DNA, 27 bp, Artificial Sequence
  Synthetic oligonucleotide
atctaccctttagattccttgacctgg

SEQ ID NO: 10139 - DNA, 27 bp, Artificial Sequence
  Synthetic oligonucleotide
tctaccctttagattccttgacctgga

SEQ ID NO: 10140 - DNA, 27 bp, Artificial Sequence
  Synthetic oligonucleotide
ctaccctttagattccttgacctggat

SEQ ID NO: 10141 - DNA, 27 bp, Artificial Sequence
  Synthetic oligonucleotide
taccctttagattccttgacctggatt

SEQ ID NO: 10142 - DNA, 27 bp, Artificial Sequence
  Synthetic oligonucleotide
accctttagattccttgacctggattg

SEQ ID NO: 10143 - DNA, 27 bp, Artificial Sequence
  Synthetic oligonucleotide
ccctttagattccttgacctggattga

SEQ ID NO: 10144 - DNA, 27 bp, Artificial Sequence
  Synthetic oligonucleotide
cctttagattccttgacctggattgaa

SEQ ID NO: 10145 - DNA, 27 bp, Artificial Sequence
  Synthetic oligonucleotide
ctttagattccttgacctggattgaat

SEQ ID NO: 10146 - DNA, 27 bp, Artificial Sequence
  Synthetic oligonucleotide
tttagattccttgacctggattgaata

SEQ ID NO: 10147 - DNA, 27 bp, Artificial Sequence
  Synthetic oligonucleotide
ttagattccttgacctggattgaatac

SEQ ID NO: 10148 - DNA, 27 bp, Artificial Sequence
  Synthetic oligonucleotide
tagattccttgacctggattgaatact

SEQ ID NO: 10149 - DNA, 27 bp, Artificial Sequence
  Synthetic oligonucleotide
agattccttgacctggattgaatactg

SEQ ID NO: 10150 - DNA, 27 bp, Artificial Sequence
  Synthetic oligonucleotide
gattccttgacctggattgaatactgg

SEQ ID NO: 10151 - DNA, 27 bp, Artificial Sequence
  Synthetic oligonucleotide
attccttgacctggattgaatactggc

SEQ ID NO: 10152 - DNA, 27 bp, Artificial Sequence
  Synthetic oligonucleotide
ttccttgacctggattgaatactggcc

SEQ ID NO: 10153 - DNA, 27 bp, Artificial Sequence
  Synthetic oligonucleotide
tccttgacctggattgaatactggcct

SEQ ID NO: 10154 - DNA, 27 bp, Artificial Sequence
  Synthetic oligonucleotide
ccttgacctggattgaatactggccta

SEQ ID NO: 10155 - DNA, 27 bp, Artificial Sequence
  Synthetic oligonucleotide
cttgacctggattgaatactggcctag

SEQ ID NO: 10156 - DNA, 27 bp, Artificial Sequence
  Synthetic oligonucleotide
ttgacctggattgaatactggcctaga

SEQ ID NO: 10157 - DNA, 27 bp, Artificial Sequence
  Synthetic oligonucleotide
tgacctggattgaatactggcctagag

SEQ ID NO: 10158 - DNA, 27 bp, Artificial Sequence
  Synthetic oligonucleotide
gacctggattgaatactggcctagaga

SEQ ID NO: 10159 - DNA, 27 bp, Artificial Sequence
  Synthetic oligonucleotide
acctggattgaatactggcctagagac

SEQ ID NO: 10160 - DNA, 27 bp, Artificial Sequence
  Synthetic oligonucleotide
cctggattgaatactggcctagagaca

SEQ ID NO: 10161 - DNA, 27 bp, Artificial Sequence
  Synthetic oligonucleotide
ctggattgaatactggcctagagacac

SEQ ID NO: 10162 - DNA, 27 bp, Artificial Sequence
  Synthetic oligonucleotide
cacaacatgttcatcgtgtcaagcatt

SEQ ID NO: 10163 - DNA, 27 bp, Artificial Sequence
  Synthetic oligonucleotide
acaacatgttcatcgtgtcaagcattt

SEQ ID NO: 10164 - DNA, 27 bp, Artificial Sequence
  Synthetic oligonucleotide
caacatgttcatcgtgtcaagcatttt

SEQ ID NO: 10165 - DNA, 27 bp, Artificial Sequence
  Synthetic oligonucleotide
aacatgttcatcgtgtcaagcattttt

SEQ ID NO: 10166 - DNA, 27 bp, Artificial Sequence
  Synthetic oligonucleotide
catgttcatcgtgtcaagcatttttag

SEQ ID NO: 10167 - DNA, 27 bp, Artificial Sequence
  Synthetic oligonucleotide
atgttcatcgtgtcaagcatttttagc

SEQ ID NO: 10168 - DNA, 27 bp, Artificial Sequence
  Synthetic oligonucleotide
tgttcatcgtgtcaagcatttttagct

SEQ ID NO: 10169 - DNA, 27 bp, Artificial Sequence
  Synthetic oligonucleotide
gttcatcgtgtcaagcatttttagcta

SEQ ID NO: 10170 - DNA, 27 bp, Artificial Sequence
  Synthetic oligonucleotide
tcatcgtgtcaagcatttttagctaat

SEQ ID NO: 10171 - DNA, 27 bp, Artificial Sequence
  Synthetic oligonucleotide
catcgtgtcaagcatttttagctaatt

SEQ ID NO: 10172 - DNA, 27 bp, Artificial Sequence
  Synthetic oligonucleotide
atcgtgtcaagcatttttagctaattt

SEQ ID NO: 10173 - DNA, 27 bp, Artificial Sequence
  Synthetic oligonucleotide
cgtgtcaagcatttttagctaatttag

SEQ ID NO: 10174 - DNA, 27 bp, Artificial Sequence
  Synthetic oligonucleotide
gtgtcaagcatttttagctaatttaga

SEQ ID NO: 10175 - DNA, 27 bp, Artificial Sequence
  Synthetic oligonucleotide
tgtcaagcatttttagctaatttagat

SEQ ID NO: 10176 - DNA, 27 bp, Artificial Sequence
  Synthetic oligonucleotide
gtcaagcatttttagctaatttagatg

SEQ ID NO: 10177 - DNA, 27 bp, Artificial Sequence
  Synthetic oligonucleotide
caagcatttttagctaatttagatgaa

SEQ ID NO: 10178 - DNA, 27 bp, Artificial Sequence
  Synthetic oligonucleotide
aagcatttttagctaatttagatgaat

SEQ ID NO: 10179 - DNA, 27 bp, Artificial Sequence
  Synthetic oligonucleotide
agcatttttagctaatttagatgaatt

SEQ ID NO: 10180 - DNA, 27 bp, Artificial Sequence
  Synthetic oligonucleotide
gcatttttagctaatttagatgaattt

SEQ ID NO: 10181 - DNA, 27 bp, Artificial Sequence
  Synthetic oligonucleotide
catttttagctaatttagatgaatttg

SEQ ID NO: 10182 - DNA, 27 bp, Artificial Sequence
  Synthetic oligonucleotide
atttttagctaatttagatgaatttgc

SEQ ID NO: 10183 - DNA, 27 bp, Artificial Sequence
  Synthetic oligonucleotide
tttttagctaatttagatgaatttgcc

SEQ ID NO: 10184 - DNA, 27 bp, Artificial Sequence
  Synthetic oligonucleotide
ttttagctaatttagatgaatttgccg

SEQ ID NO: 10185 - DNA, 27 bp, Artificial Sequence
  Synthetic oligonucleotide
tttagctaatttagatgaatttgccga

SEQ ID NO: 10186 - DNA, 27 bp, Artificial Sequence
  Synthetic oligonucleotide
ttagctaatttagatgaatttgccgaa

SEQ ID NO: 10187 - DNA, 27 bp, Artificial Sequence
  Synthetic oligonucleotide
tagctaatttagatgaatttgccgaag

SEQ ID NO: 10188 - DNA, 27 bp, Artificial Sequence
  Synthetic oligonucleotide
agctaatttagatgaatttgccgaaga

SEQ ID NO: 10189 - DNA, 27 bp, Artificial Sequence
  Synthetic oligonucleotide
atatctttttaaatggatgctaaaatt

SEQ ID NO: 10190 - DNA, 27 bp, Artificial Sequence
  Synthetic oligonucleotide
tatctttttaaatggatgctaaaattc

SEQ ID NO: 10191 - DNA, 27 bp, Artificial Sequence
  Synthetic oligonucleotide
atctttttaaatggatgctaaaattcc

SEQ ID NO: 10192 - DNA, 27 bp, Artificial Sequence
  Synthetic oligonucleotide
tctttttaaatggatgctaaaattcct

SEQ ID NO: 10193 - DNA, 27 bp, Artificial Sequence
  Synthetic oligonucleotide
ctttttaaatggatgctaaaattcctg

SEQ ID NO: 10194 - DNA, 27 bp, Artificial Sequence
  Synthetic oligonucleotide
tttttaaatggatgctaaaattcctga

SEQ ID NO: 10195 - DNA, 27 bp, Artificial Sequence
  Synthetic oligonucleotide
ttttaaatggatgctaaaattcctgaa

SEQ ID NO: 10196 - DNA, 27 bp, Artificial Sequence
  Synthetic oligonucleotide
tttaaatggatgctaaaattcctgaag

SEQ ID NO: 10197 - DNA, 27 bp, Artificial Sequence
  Synthetic oligonucleotide
ttaaatggatgctaaaattcctgaagt

SEQ ID NO: 10198 - DNA, 27 bp, Artificial Sequence
  Synthetic oligonucleotide
taaatggatgctaaaattcctgaagtt

SEQ ID NO: 10199 - DNA, 27 bp, Artificial Sequence
  Synthetic oligonucleotide
aaatggatgctaaaattcctgaagttc

SEQ ID NO: 10200 - DNA, 27 bp, Artificial Sequence
  Synthetic oligonucleotide
atggatgctaaaattcctgaagttcag

SEQ ID NO: 10201 - DNA, 27 bp, Artificial Sequence
  Synthetic oligonucleotide
tggatgctaaaattcctgaagttcagc

SEQ ID NO: 10202 - DNA, 27 bp, Artificial Sequence
  Synthetic oligonucleotide
ggatgctaaaattcctgaagttcagct

SEQ ID NO: 10203 - DNA, 27 bp, Artificial Sequence
  Synthetic oligonucleotide
gatgctaaaattcctgaagttcagctg

SEQ ID NO: 10204 - DNA, 27 bp, Artificial Sequence
  Synthetic oligonucleotide
atgctaaaattcctgaagttcagctgc

SEQ ID NO: 10205 - DNA, 27 bp, Artificial Sequence
  Synthetic oligonucleotide
tgctaaaattcctgaagttcagctgca

SEQ ID NO: 10206 - DNA, 27 bp, Artificial Sequence
  Synthetic oligonucleotide
gctaaaattcctgaagttcagctgcat

SEQ ID NO: 10207 - DNA, 27 bp, Artificial Sequence
  Synthetic oligonucleotide
ctaaaattcctgaagttcagctgcata

SEQ ID NO: 10208 - DNA, 27 bp, Artificial Sequence
  Synthetic oligonucleotide
taaaattcctgaagttcagctgcatac

SEQ ID NO: 10209 - DNA, 27 bp, Artificial Sequence
  Synthetic oligonucleotide
aaaattcctgaagttcagctgcataca

SEQ ID NO: 10210 - DNA, 27 bp, Artificial Sequence
  Synthetic oligonucleotide
aaattcctgaagttcagctgcatacag

SEQ ID NO: 10211 - DNA, 27 bp, Artificial Sequence
  Synthetic oligonucleotide
aattcctgaagttcagctgcatacagt

SEQ ID NO: 10212 - DNA, 27 bp, Artificial Sequence
  Synthetic oligonucleotide
attcctgaagttcagctgcatacagtt

SEQ ID NO: 10213 - DNA, 27 bp, Artificial Sequence
  Synthetic oligonucleotide
ttcctgaagttcagctgcatacagttt

SEQ ID NO: 10214 - DNA, 27 bp, Artificial Sequence
  Synthetic oligonucleotide
tcctgaagttcagctgcatacagtttg

SEQ ID NO: 10215 - DNA, 27 bp, Artificial Sequence
  Synthetic oligonucleotide
cctgaagttcagctgcatacagtttgc

SEQ ID NO: 10216 - DNA, 27 bp, Artificial Sequence
  Synthetic oligonucleotide
ctgaagttcagctgcatacagtttgca

SEQ ID NO: 10217 - DNA, 27 bp, Artificial Sequence
  Synthetic oligonucleotide
tgaagttcagctgcatacagtttgcac

SEQ ID NO: 10218 - DNA, 27 bp, Artificial Sequence
  Synthetic oligonucleotide
gaagttcagctgcatacagtttgcact

SEQ ID NO: 10219 - DNA, 27 bp, Artificial Sequence
  Synthetic oligonucleotide
aagttcagctgcatacagtttgcactt

SEQ ID NO: 10220 - DNA, 27 bp, Artificial Sequence
  Synthetic oligonucleotide
agttcagctgcatacagtttgcactta

SEQ ID NO: 10221 - DNA, 27 bp, Artificial Sequence
  Synthetic oligonucleotide
gttcagctgcatacagtttgcacttat

SEQ ID NO: 10222 - DNA, 27 bp, Artificial Sequence
  Synthetic oligonucleotide
ttcagctgcatacagtttgcacttatg

SEQ ID NO: 10223 - DNA, 27 bp, Artificial Sequence
  Synthetic oligonucleotide
tcagctgcatacagtttgcacttatgg

SEQ ID NO: 10224 - DNA, 27 bp, Artificial Sequence
  Synthetic oligonucleotide
cagctgcatacagtttgcacttatgga

SEQ ID NO: 10225 - DNA, 27 bp, Artificial Sequence
  Synthetic oligonucleotide
agctgcatacagtttgcacttatggac

SEQ ID NO: 10226 - DNA, 27 bp, Artificial Sequence
  Synthetic oligonucleotide
gctgcatacagtttgcacttatggact

SEQ ID NO: 10227 - DNA, 27 bp, Artificial Sequence
  Synthetic oligonucleotide
ctgcatacagtttgcacttatggactc

SEQ ID NO: 10228 - DNA, 27 bp, Artificial Sequence
  Synthetic oligonucleotide
tgcatacagtttgcacttatggactcc

SEQ ID NO: 10229 - DNA, 27 bp, Artificial Sequence
  Synthetic oligonucleotide
gcatacagtttgcacttatggactcct

SEQ ID NO: 10230 - DNA, 27 bp, Artificial Sequence
  Synthetic oligonucleotide
catacagtttgcacttatggactcctg

SEQ ID NO: 10231 - DNA, 27 bp, Artificial Sequence
  Synthetic oligonucleotide
atacagtttgcacttatggactcctgt

SEQ ID NO: 10232 - DNA, 27 bp, Artificial Sequence
  Synthetic oligonucleotide
tacagtttgcacttatggactcctgtt

SEQ ID NO: 10233 - DNA, 27 bp, Artificial Sequence
  Synthetic oligonucleotide
acagtttgcacttatggactcctgttg

SEQ ID NO: 10234 - DNA, 27 bp, Artificial Sequence
  Synthetic oligonucleotide
cagtttgcacttatggactcctgttgt

SEQ ID NO: 10235 - DNA, 27 bp, Artificial Sequence
  Synthetic oligonucleotide
agtttgcacttatggactcctgttgtt

SEQ ID NO: 10236 - DNA, 27 bp, Artificial Sequence
  Synthetic oligonucleotide
gtttgcacttatggactcctgttgttg

SEQ ID NO: 10237 - DNA, 27 bp, Artificial Sequence
  Synthetic oligonucleotide
tttgcacttatggactcctgttgttga

SEQ ID NO: 10238 - DNA, 27 bp, Artificial Sequence
  Synthetic oligonucleotide
ttgcacttatggactcctgttgttgaa

SEQ ID NO: 10239 - DNA, 27 bp, Artificial Sequence
  Synthetic oligonucleotide
tgcacttatggactcctgttgttgaag

SEQ ID NO: 10240 - DNA, 27 bp, Artificial Sequence
  Synthetic oligonucleotide
gcacttatggactcctgttgttgaagt

SEQ ID NO: 10241 - DNA, 27 bp, Artificial Sequence
  Synthetic oligonucleotide
cacttatggactcctgttgttgaagtt

SEQ ID NO: 10242 - DNA, 27 bp, Artificial Sequence
  Synthetic oligonucleotide
acttatggactcctgttgttgaagttc

SEQ ID NO: 10243 - DNA, 27 bp, Artificial Sequence
  Synthetic oligonucleotide
cttatggactcctgttgttgaagttcg

SEQ ID NO: 10244 - DNA, 27 bp, Artificial Sequence
  Synthetic oligonucleotide
tatggactcctgttgttgaagttcgtt

SEQ ID NO: 10245 - DNA, 27 bp, Artificial Sequence
  Synthetic oligonucleotide
atagctggtcttatttgtaaagctcac

SEQ ID NO: 10246 - DNA, 27 bp, Artificial Sequence
  Synthetic oligonucleotide
tagctggtcttatttgtaaagctcact

SEQ ID NO: 10247 - DNA, 27 bp, Artificial Sequence
  Synthetic oligonucleotide
agctggtcttatttgtaaagctcactt

SEQ ID NO: 10248 - DNA, 27 bp, Artificial Sequence
  Synthetic oligonucleotide
gctggtcttatttgtaaagctcacttt

SEQ ID NO: 10249 - DNA, 27 bp, Artificial Sequence
  Synthetic oligonucleotide
ctggtcttatttgtaaagctcacttta

SEQ ID NO: 10250 - DNA, 27 bp, Artificial Sequence
  Synthetic oligonucleotide
tggtcttatttgtaaagctcactttac

SEQ ID NO: 10251 - DNA, 27 bp, Artificial Sequence
  Synthetic oligonucleotide
ggtcttatttgtaaagctcactttact

SEQ ID NO: 10252 - DNA, 27 bp, Artificial Sequence
  Synthetic oligonucleotide
gtcttatttgtaaagctcactttactt

SEQ ID NO: 10253 - DNA, 27 bp, Artificial Sequence
  Synthetic oligonucleotide
tcttatttgtaaagctcactttactta

SEQ ID NO: 10254 - DNA, 27 bp, Artificial Sequence
  Synthetic oligonucleotide
cttatttgtaaagctcactttacttag

SEQ ID NO: 10255 - DNA, 27 bp, Artificial Sequence
  Synthetic oligonucleotide
ttatttgtaaagctcactttacttaga

SEQ ID NO: 10256 - DNA, 27 bp, Artificial Sequence
  Synthetic oligonucleotide
tatttgtaaagctcactttacttagaa

SEQ ID NO: 10257 - DNA, 27 bp, Artificial Sequence
  Synthetic oligonucleotide
atttgtaaagctcactttacttagaat

SEQ ID NO: 10258 - DNA, 27 bp, Artificial Sequence
  Synthetic oligonucleotide
tttgtaaagctcactttacttagaatt

SEQ ID NO: 10259 - DNA, 27 bp, Artificial Sequence
  Synthetic oligonucleotide
ttgtaaagctcactttacttagaatta

SEQ ID NO: 10260 - DNA, 27 bp, Artificial Sequence
  Synthetic oligonucleotide
tgtaaagctcactttacttagaattag

SEQ ID NO: 10261 - DNA, 27 bp, Artificial Sequence
  Synthetic oligonucleotide
gtaaagctcactttacttagaattagt

SEQ ID NO: 10262 - DNA, 27 bp, Artificial Sequence
  Synthetic oligonucleotide
taaagctcactttacttagaattagtg

SEQ ID NO: 10263 - DNA, 27 bp, Artificial Sequence
  Synthetic oligonucleotide
aaagctcactttacttagaattagtgg

SEQ ID NO: 10264 - DNA, 27 bp, Artificial Sequence
  Synthetic oligonucleotide
aagctcactttacttagaattagtggc

SEQ ID NO: 10265 - DNA, 27 bp, Artificial Sequence
  Synthetic oligonucleotide
agctcactttacttagaattagtggca

SEQ ID NO: 10266 - DNA, 27 bp, Artificial Sequence
  Synthetic oligonucleotide
gctcactttacttagaattagtggcac

SEQ ID NO: 10267 - DNA, 27 bp, Artificial Sequence
  Synthetic oligonucleotide
ctcactttacttagaattagtggcact

SEQ ID NO: 10268 - DNA, 27 bp, Artificial Sequence
  Synthetic oligonucleotide
tcactttacttagaattagtggcactt

SEQ ID NO: 10269 - DNA, 27 bp, Artificial Sequence
  Synthetic oligonucleotide
cactttacttagaattagtggcacttg

SEQ ID NO: 10270 - DNA, 27 bp, Artificial Sequence
  Synthetic oligonucleotide
actttacttagaattagtggcacttgc

SEQ ID NO: 10271 - DNA, 27 bp, Artificial Sequence
  Synthetic oligonucleotide
ctttacttagaattagtggcacttgct

SEQ ID NO: 10272 - DNA, 27 bp, Artificial Sequence
  Synthetic oligonucleotide
tttacttagaattagtggcacttgctt

SEQ ID NO: 10273 - DNA, 27 bp, Artificial Sequence
  Synthetic oligonucleotide
ttacttagaattagtggcacttgcttt

SEQ ID NO: 10274 - DNA, 27 bp, Artificial Sequence
  Synthetic oligonucleotide
tacttagaattagtggcacttgctttt

SEQ ID NO: 10275 - DNA, 27 bp, Artificial Sequence
  Synthetic oligonucleotide
acttagaattagtggcacttgctttta

SEQ ID NO: 10276 - DNA, 27 bp, Artificial Sequence
  Synthetic oligonucleotide
cttagaattagtggcacttgcttttat

SEQ ID NO: 10277 - DNA, 27 bp, Artificial Sequence
  Synthetic oligonucleotide
ttagaattagtggcacttgcttttatt

SEQ ID NO: 10278 - DNA, 27 bp, Artificial Sequence
  Synthetic oligonucleotide
tagaattagtggcacttgcttttatta

SEQ ID NO: 10279 - DNA, 27 bp, Artificial Sequence
  Synthetic oligonucleotide
agaattagtggcacttgcttttattag

SEQ ID NO: 10280 - DNA, 27 bp, Artificial Sequence
  Synthetic oligonucleotide
gaattagtggcacttgcttttattaga

SEQ ID NO: 10281 - DNA, 27 bp, Artificial Sequence
  Synthetic oligonucleotide
aattagtggcacttgcttttattagag

SEQ ID NO: 10282 - DNA, 27 bp, Artificial Sequence
  Synthetic oligonucleotide
attagtggcacttgcttttattagaga

SEQ ID NO: 10283 - DNA, 27 bp, Artificial Sequence
  Synthetic oligonucleotide
ttagtggcacttgcttttattagagaa

SEQ ID NO: 10284 - DNA, 27 bp, Artificial Sequence
  Synthetic oligonucleotide
tagtggcacttgcttttattagagaat

SEQ ID NO: 10285 - DNA, 27 bp, Artificial Sequence
  Synthetic oligonucleotide
agtggcacttgcttttattagagaatg

SEQ ID NO: 10286 - DNA, 27 bp, Artificial Sequence
  Synthetic oligonucleotide
gtggcacttgcttttattagagaatga

SEQ ID NO: 10287 - DNA, 27 bp, Artificial Sequence
  Synthetic oligonucleotide
tggcacttgcttttattagagaatgat

SEQ ID NO: 10288 - DNA, 27 bp, Artificial Sequence
  Synthetic oligonucleotide
ggcacttgcttttattagagaatgatt

SEQ ID NO: 10289 - DNA, 27 bp, Artificial Sequence
  Synthetic oligonucleotide
gcacttgcttttattagagaatgattt

SEQ ID NO: 10290 - DNA, 27 bp, Artificial Sequence
  Synthetic oligonucleotide
cacttgcttttattagagaatgatttc

SEQ ID NO: 10291 - DNA, 27 bp, Artificial Sequence
  Synthetic oligonucleotide
gcttttattagagaatgatttcaaatg

SEQ ID NO: 10292 - DNA, 27 bp, Artificial Sequence
  Synthetic oligonucleotide
atgctgtaactttctgaaataacatgg

SEQ ID NO: 10293 - DNA, 27 bp, Artificial Sequence
  Synthetic oligonucleotide
tgctgtaactttctgaaataacatggc

SEQ ID NO: 10294 - DNA, 27 bp, Artificial Sequence
  Synthetic oligonucleotide
gctgtaactttctgaaataacatggcc

SEQ ID NO: 10295 - DNA, 27 bp, Artificial Sequence
  Synthetic oligonucleotide
ctgtaactttctgaaataacatggcct

SEQ ID NO: 10296 - DNA, 27 bp, Artificial Sequence
  Synthetic oligonucleotide
tgtaactttctgaaataacatggcctt

SEQ ID NO: 10297 - DNA, 27 bp, Artificial Sequence
  Synthetic oligonucleotide
gtaactttctgaaataacatggccttg

SEQ ID NO: 10298 - DNA, 27 bp, Artificial Sequence
  Synthetic oligonucleotide
taactttctgaaataacatggccttgg

SEQ ID NO: 10299 - DNA, 27 bp, Artificial Sequence
  Synthetic oligonucleotide
aactttctgaaataacatggccttgga

SEQ ID NO: 10300 - DNA, 27 bp, Artificial Sequence
  Synthetic oligonucleotide
actttctgaaataacatggccttggag

SEQ ID NO: 10301 - DNA, 27 bp, Artificial Sequence
  Synthetic oligonucleotide
ctttctgaaataacatggccttggagg

SEQ ID NO: 10302 - DNA, 27 bp, Artificial Sequence
  Synthetic oligonucleotide
tttctgaaataacatggccttggaggg

SEQ ID NO: 10303 - DNA, 27 bp, Artificial Sequence
  Synthetic oligonucleotide
ttctgaaataacatggccttggagggc

SEQ ID NO: 10304 - DNA, 27 bp, Artificial Sequence
  Synthetic oligonucleotide
tctgaaataacatggccttggagggca

SEQ ID NO: 10305 - DNA, 27 bp, Artificial Sequence
  Synthetic oligonucleotide
ctgaaataacatggccttggagggcat

SEQ ID NO: 10306 - DNA, 27 bp, Artificial Sequence
  Synthetic oligonucleotide
tgaaataacatggccttggagggcatg

SEQ ID NO: 10307 - DNA, 27 bp, Artificial Sequence
  Synthetic oligonucleotide
gaaataacatggccttggagggcatga

SEQ ID NO: 10308 - DNA, 27 bp, Artificial Sequence
  Synthetic oligonucleotide
aaataacatggccttggagggcatgaa

SEQ ID NO: 10309 - DNA, 27 bp, Artificial Sequence
  Synthetic oligonucleotide
aataacatggccttggagggcatgaag

SEQ ID NO: 10310 - DNA, 27 bp, Artificial Sequence
  Synthetic oligonucleotide
ataacatggccttggagggcatgaaga

SEQ ID NO: 10311 - DNA, 27 bp, Artificial Sequence
  Synthetic oligonucleotide
taacatggccttggagggcatgaagac

SEQ ID NO: 10312 - DNA, 27 bp, Artificial Sequence
  Synthetic oligonucleotide
aacatggccttggagggcatgaagaca

SEQ ID NO: 10313 - DNA, 27 bp, Artificial Sequence
  Synthetic oligonucleotide
acatggccttggagggcatgaagacag

SEQ ID NO: 10314 - DNA, 27 bp, Artificial Sequence
  Synthetic oligonucleotide
catggccttggagggcatgaagacaga

SEQ ID NO: 10315 - DNA, 27 bp, Artificial Sequence
  Synthetic oligonucleotide
atggccttggagggcatgaagacagat

SEQ ID NO: 10316 - DNA, 27 bp, Artificial Sequence
  Synthetic oligonucleotide
tggccttggagggcatgaagacagata

SEQ ID NO: 10317 - DNA, 27 bp, Artificial Sequence
  Synthetic oligonucleotide
ggccttggagggcatgaagacagatac

SEQ ID NO: 10318 - DNA, 27 bp, Artificial Sequence
  Synthetic oligonucleotide
gccttggagggcatgaagacagatact

SEQ ID NO: 10319 - DNA, 27 bp, Artificial Sequence
  Synthetic oligonucleotide
ccttggagggcatgaagacagatactc

SEQ ID NO: 10320 - DNA, 27 bp, Artificial Sequence
  Synthetic oligonucleotide
cttggagggcatgaagacagatactcc

SEQ ID NO: 10321 - DNA, 27 bp, Artificial Sequence
  Synthetic oligonucleotide
ttggagggcatgaagacagatactcct

SEQ ID NO: 10322 - DNA, 27 bp, Artificial Sequence
  Synthetic oligonucleotide
tggagggcatgaagacagatactcctc

SEQ ID NO: 10323 - DNA, 27 bp, Artificial Sequence
  Synthetic oligonucleotide
ggagggcatgaagacagatactcctcc

SEQ ID NO: 10324 - DNA, 27 bp, Artificial Sequence
  Synthetic oligonucleotide
gagggcatgaagacagatactcctcca

SEQ ID NO: 10325 - DNA, 27 bp, Artificial Sequence
  Synthetic oligonucleotide
agggcatgaagacagatactcctccaa

SEQ ID NO: 10326 - DNA, 27 bp, Artificial Sequence
  Synthetic oligonucleotide
gggcatgaagacagatactcctccaag

SEQ ID NO: 10327 - DNA, 27 bp, Artificial Sequence
  Synthetic oligonucleotide
ggcatgaagacagatactcctccaagg

SEQ ID NO: 10328 - DNA, 27 bp, Artificial Sequence
  Synthetic oligonucleotide
gcatgaagacagatactcctccaaggt

SEQ ID NO: 10329 - DNA, 27 bp, Artificial Sequence
  Synthetic oligonucleotide
catgaagacagatactcctccaaggtt

SEQ ID NO: 10330 - DNA, 27 bp, Artificial Sequence
  Synthetic oligonucleotide
atgaagacagatactcctccaaggtta

SEQ ID NO: 10331 - DNA, 27 bp, Artificial Sequence
  Synthetic oligonucleotide
tgaagacagatactcctccaaggttat

SEQ ID NO: 10332 - DNA, 27 bp, Artificial Sequence
  Synthetic oligonucleotide
gaagacagatactcctccaaggttatt

SEQ ID NO: 10333 - DNA, 27 bp, Artificial Sequence
  Synthetic oligonucleotide
aagacagatactcctccaaggttattg

SEQ ID NO: 10334 - DNA, 27 bp, Artificial Sequence
  Synthetic oligonucleotide
agacagatactcctccaaggttattgg

SEQ ID NO: 10335 - DNA, 27 bp, Artificial Sequence
  Synthetic oligonucleotide
acagatactcctccaaggttattggac

SEQ ID NO: 10336 - DNA, 27 bp, Artificial Sequence
  Synthetic oligonucleotide
cagatactcctccaaggttattggaca

SEQ ID NO: 10337 - DNA, 27 bp, Artificial Sequence
  Synthetic oligonucleotide
agatactcctccaaggttattggacac

SEQ ID NO: 10338 - DNA, 27 bp, Artificial Sequence
  Synthetic oligonucleotide
gatactcctccaaggttattggacacc

SEQ ID NO: 10339 - DNA, 27 bp, Artificial Sequence
  Synthetic oligonucleotide
atactcctccaaggttattggacaccg

SEQ ID NO: 10340 - DNA, 27 bp, Artificial Sequence
  Synthetic oligonucleotide
tactcctccaaggttattggacaccgg

SEQ ID NO: 10341 - DNA, 27 bp, Artificial Sequence
  Synthetic oligonucleotide
actcctccaaggttattggacaccgga

SEQ ID NO: 10342 - DNA, 27 bp, Artificial Sequence
  Synthetic oligonucleotide
ctcctccaaggttattggacaccggaa

SEQ ID NO: 10343 - DNA, 27 bp, Artificial Sequence
  Synthetic oligonucleotide
tcctccaaggttattggacaccggaaa

SEQ ID NO: 10344 - DNA, 27 bp, Artificial Sequence
  Synthetic oligonucleotide
cctccaaggttattggacaccggaaac

SEQ ID NO: 10345 - DNA, 27 bp, Artificial Sequence
  Synthetic oligonucleotide
ctccaaggttattggacaccggaaaca

SEQ ID NO: 10346 - DNA, 27 bp, Artificial Sequence
  Synthetic oligonucleotide
tccaaggttattggacaccggaaacaa

SEQ ID NO: 10347 - DNA, 27 bp, Artificial Sequence
  Synthetic oligonucleotide
ccaaggttattggacaccggaaacaat

SEQ ID NO: 10348 - DNA, 27 bp, Artificial Sequence
  Synthetic oligonucleotide
caaggttattggacaccggaaacaata

SEQ ID NO: 10349 - DNA, 27 bp, Artificial Sequence
  Synthetic oligonucleotide
aaggttattggacaccggaaacaataa

SEQ ID NO: 10350 - DNA, 27 bp, Artificial Sequence
  Synthetic oligonucleotide
aggttattggacaccggaaacaataaa

SEQ ID NO: 10351 - DNA, 27 bp, Artificial Sequence
  Synthetic oligonucleotide
ggttattggacaccggaaacaataaat

SEQ ID NO: 10352 - DNA, 27 bp, Artificial Sequence
  Synthetic oligonucleotide
gttattggacaccggaaacaataaatt

SEQ ID NO: 10353 - DNA, 27 bp, Artificial Sequence
  Synthetic oligonucleotide
ttattggacaccggaaacaataaattg

SEQ ID NO: 10354 - DNA, 27 bp, Artificial Sequence
  Synthetic oligonucleotide
tattggacaccggaaacaataaattgg

SEQ ID NO: 10355 - DNA, 27 bp, Artificial Sequence
  Synthetic oligonucleotide
attggacaccggaaacaataaattgga

SEQ ID NO: 10356 - DNA, 27 bp, Artificial Sequence
  Synthetic oligonucleotide
ttggacaccggaaacaataaattggaa

SEQ ID NO: 10357 - DNA, 27 bp, Artificial Sequence
  Synthetic oligonucleotide
tggacaccggaaacaataaattggaac

SEQ ID NO: 10358 - DNA, 27 bp, Artificial Sequence
  Synthetic oligonucleotide
ggacaccggaaacaataaattggaaca

SEQ ID NO: 10359 - DNA, 27 bp, Artificial Sequence
  Synthetic oligonucleotide
tggaacacctcctcaaacctaccactc

SEQ ID NO: 10360 - DNA, 27 bp, Artificial Sequence
  Synthetic oligonucleotide
ggaacacctcctcaaacctaccactca

SEQ ID NO: 10361 - DNA, 27 bp, Artificial Sequence
  Synthetic oligonucleotide
gaacacctcctcaaacctaccactcag

SEQ ID NO: 10362 - DNA, 27 bp, Artificial Sequence
  Synthetic oligonucleotide
aacacctcctcaaacctaccactcagg

SEQ ID NO: 10363 - DNA, 27 bp, Artificial Sequence
  Synthetic oligonucleotide
acacctcctcaaacctaccactcagga

SEQ ID NO: 10364 - DNA, 27 bp, Artificial Sequence
  Synthetic oligonucleotide
cacctcctcaaacctaccactcaggaa

SEQ ID NO: 10365 - DNA, 27 bp, Artificial Sequence
  Synthetic oligonucleotide
gggccgaaagaacagtccattgaaagg

SEQ ID NO: 10366 - DNA, 27 bp, Artificial Sequence
  Synthetic oligonucleotide
ggccgaaagaacagtccattgaaaggg

SEQ ID NO: 10367 - DNA, 27 bp, Artificial Sequence
  Synthetic oligonucleotide
gccgaaagaacagtccattgaaaggga

SEQ ID NO: 10368 - DNA, 27 bp, Artificial Sequence
  Synthetic oligonucleotide
ccgaaagaacagtccattgaaagggag

SEQ ID NO: 10369 - DNA, 27 bp, Artificial Sequence
  Synthetic oligonucleotide
cgaaagaacagtccattgaaagggagt

SEQ ID NO: 10370 - DNA, 27 bp, Artificial Sequence
  Synthetic oligonucleotide
agggagtattacaaaaacatggccttt

SEQ ID NO: 10371 - DNA, 27 bp, Artificial Sequence
  Synthetic oligonucleotide
gggagtattacaaaaacatggcctttg

SEQ ID NO: 10372 - DNA, 27 bp, Artificial Sequence
  Synthetic oligonucleotide
ggagtattacaaaaacatggcctttgc

SEQ ID NO: 10373 - DNA, 27 bp, Artificial Sequence
  Synthetic oligonucleotide
gagtattacaaaaacatggcctttgct

SEQ ID NO: 10374 - DNA, 27 bp, Artificial Sequence
  Synthetic oligonucleotide
agtattacaaaaacatggcctttgctt

SEQ ID NO: 10375 - DNA, 27 bp, Artificial Sequence
  Synthetic oligonucleotide
gtattacaaaaacatggcctttgcttg

SEQ ID NO: 10376 - DNA, 27 bp, Artificial Sequence
  Synthetic oligonucleotide
tattacaaaaacatggcctttgcttga

SEQ ID NO: 10377 - DNA, 27 bp, Artificial Sequence
  Synthetic oligonucleotide
attacaaaaacatggcctttgcttgaa

SEQ ID NO: 10378 - DNA, 27 bp, Artificial Sequence
  Synthetic oligonucleotide
ttacaaaaacatggcctttgcttgaaa

SEQ ID NO: 10379 - DNA, 27 bp, Artificial Sequence
  Synthetic oligonucleotide
tacaaaaacatggcctttgcttgaaag

SEQ ID NO: 10380 - DNA, 27 bp, Artificial Sequence
  Synthetic oligonucleotide
acaaaaacatggcctttgcttgaaaga

SEQ ID NO: 10381 - DNA, 27 bp, Artificial Sequence
  Synthetic oligonucleotide
caaaaacatggcctttgcttgaaagaa

SEQ ID NO: 10382 - DNA, 27 bp, Artificial Sequence
  Synthetic oligonucleotide
aaaaacatggcctttgcttgaaagaaa

SEQ ID NO: 10383 - DNA, 27 bp, Artificial Sequence
  Synthetic oligonucleotide
aaaacatggcctttgcttgaaagaaaa

SEQ ID NO: 10384 - DNA, 27 bp, Artificial Sequence
  Synthetic oligonucleotide
aaacatggcctttgcttgaaagaaaat

SEQ ID NO: 10385 - DNA, 27 bp, Artificial Sequence
  Synthetic oligonucleotide
aacatggcctttgcttgaaagaaaata

SEQ ID NO: 10386 - DNA, 27 bp, Artificial Sequence
  Synthetic oligonucleotide
acatggcctttgcttgaaagaaaatac

SEQ ID NO: 10387 - DNA, 27 bp, Artificial Sequence
  Synthetic oligonucleotide
catggcctttgcttgaaagaaaatacc

SEQ ID NO: 10388 - DNA, 27 bp, Artificial Sequence
  Synthetic oligonucleotide
atggcctttgcttgaaagaaaatacca

SEQ ID NO: 10389 - DNA, 27 bp, Artificial Sequence
  Synthetic oligonucleotide
tggcctttgcttgaaagaaaataccaa

SEQ ID NO: 10390 - DNA, 27 bp, Artificial Sequence
  Synthetic oligonucleotide
ggcctttgcttgaaagaaaataccaag

SEQ ID NO: 10391 - DNA, 27 bp, Artificial Sequence
  Synthetic oligonucleotide
gcctttgcttgaaagaaaataccaagg

SEQ ID NO: 10392 - DNA, 27 bp, Artificial Sequence
  Synthetic oligonucleotide
cctttgcttgaaagaaaataccaagga

SEQ ID NO: 10393 - DNA, 27 bp, Artificial Sequence
  Synthetic oligonucleotide
ctttgcttgaaagaaaataccaaggaa

SEQ ID NO: 10394 - DNA, 27 bp, Artificial Sequence
  Synthetic oligonucleotide
tttgcttgaaagaaaataccaaggaac

SEQ ID NO: 10395 - DNA, 27 bp, Artificial Sequence
  Synthetic oligonucleotide
gaacaggaaactgatcattaaagcctg

SEQ ID NO: 10396 - DNA, 27 bp, Artificial Sequence
  Synthetic oligonucleotide
aacaggaaactgatcattaaagcctga

SEQ ID NO: 10397 - DNA, 27 bp, Artificial Sequence
  Synthetic oligonucleotide
acaggaaactgatcattaaagcctgag

SEQ ID NO: 10398 - DNA, 27 bp, Artificial Sequence
  Synthetic oligonucleotide
caggaaactgatcattaaagcctgagt

SEQ ID NO: 10399 - DNA, 27 bp, Artificial Sequence
  Synthetic oligonucleotide
aggaaactgatcattaaagcctgagtt

SEQ ID NO: 10400 - DNA, 27 bp, Artificial Sequence
  Synthetic oligonucleotide
ggaaactgatcattaaagcctgagttt

SEQ ID NO: 10401 - DNA, 27 bp, Artificial Sequence
  Synthetic oligonucleotide
gaaactgatcattaaagcctgagtttg

SEQ ID NO: 10402 - DNA, 27 bp, Artificial Sequence
  Synthetic oligonucleotide
aaactgatcattaaagcctgagtttgc

SEQ ID NO: 10403 - DNA, 27 bp, Artificial Sequence
  Synthetic oligonucleotide
aactgatcattaaagcctgagtttgct

SEQ ID NO: 10404 - DNA, 27 bp, Artificial Sequence
  Synthetic oligonucleotide
actgatcattaaagcctgagtttgctt

SEQ ID NO: 10405 - DNA, 27 bp, Artificial Sequence
  Synthetic oligonucleotide
ctgatcattaaagcctgagtttgcttt

SEQ ID NO: 10406 - DNA, 27 bp, Artificial Sequence
  Synthetic oligonucleotide
tgatcattaaagcctgagtttgctttc

SEQ ID NO: 10407 - DNA, 27 bp, Artificial Sequence
  Synthetic oligonucleotide
gatcattaaagcctgagtttgctttca

SEQ ID NO: 10408 - DNA, 27 bp, Artificial Sequence
  Synthetic oligonucleotide
cattaaagcctgagtttgctttcaaaa

SEQ ID NO: 10409 - DNA, 27 bp, Artificial Sequence
  Synthetic oligonucleotide
attaaagcctgagtttgctttcaaaaa

SEQ ID NO: 10410 - RNA, 21 nt, Artificial Sequence
  Synthetic oligonucleotide
uccugcuaccuccaaccaugg

SEQ ID NO: 10411 - RNA, 21 nt, Artificial Sequence
  Synthetic oligonucleotide
ccugcuaccuccaaccauggg

SEQ ID NO: 10412 - RNA, 21 nt, Artificial Sequence
  Synthetic oligonucleotide
cugcuaccuccaaccaugggc

SEQ ID NO: 10413 - RNA, 21 nt, Artificial Sequence
  Synthetic oligonucleotide
ugcuaccuccaaccaugggcc

SEQ ID NO: 10414 - RNA, 21 nt, Artificial Sequence
  Synthetic oligonucleotide
uaccuccaaccaugggccuuu

SEQ ID NO: 10415 - RNA, 21 nt, Artificial Sequence
  Synthetic oligonucleotide
accuccaaccaugggccuuuu

SEQ ID NO: 10416 - RNA, 21 nt, Artificial Sequence
  Synthetic oligonucleotide
ccuccaaccaugggccuuuug

SEQ ID NO: 10417 - RNA, 21 nt, Artificial Sequence
  Synthetic oligonucleotide
cuccaaccaugggccuuuugg

SEQ ID NO: 10418 - RNA, 21 nt, Artificial Sequence
  Synthetic oligonucleotide
uccaaccaugggccuuuuggg

SEQ ID NO: 10419 - RNA, 21 nt, Artificial Sequence
  Synthetic oligonucleotide
ccaaccaugggccuuuuggga

SEQ ID NO: 10420 - RNA, 21 nt, Artificial Sequence
  Synthetic oligonucleotide
caaccaugggccuuuugggaa

SEQ ID NO: 10421 - RNA, 21 nt, Artificial Sequence
  Synthetic oligonucleotide
aaccaugggccuuuugggaau

SEQ ID NO: 10422 - RNA, 21 nt, Artificial Sequence
  Synthetic oligonucleotide
accaugggccuuuugggaaua

SEQ ID NO: 10423 - RNA, 21 nt, Artificial Sequence
  Synthetic oligonucleotide
ccaugggccuuuugggaauac

SEQ ID NO: 10424 - RNA, 21 nt, Artificial Sequence
  Synthetic oligonucleotide
caugggccuuuugggaauacu

SEQ ID NO: 10425 - RNA, 21 nt, Artificial Sequence
  Synthetic oligonucleotide
augggccuuuugggaauacuu

SEQ ID NO: 10426 - RNA, 21 nt, Artificial Sequence
  Synthetic oligonucleotide
ugggccuuuugggaauacuuu

SEQ ID NO: 10427 - RNA, 21 nt, Artificial Sequence
  Synthetic oligonucleotide
gggccuuuugggaauacuuug

SEQ ID NO: 10428 - RNA, 21 nt, Artificial Sequence
  Synthetic oligonucleotide
ggccuuuugggaauacuuugu

SEQ ID NO: 10429 - RNA, 21 nt, Artificial Sequence
  Synthetic oligonucleotide
gccuuuugggaauacuuuguu

SEQ ID NO: 10430 - RNA, 21 nt, Artificial Sequence
  Synthetic oligonucleotide
ccuuuugggaauacuuuguuu

SEQ ID NO: 10431 - RNA, 21 nt, Artificial Sequence
  Synthetic oligonucleotide
cuuuugggaauacuuuguuuu

SEQ ID NO: 10432 - RNA, 21 nt, Artificial Sequence
  Synthetic oligonucleotide
uuuugggaauacuuuguuuuu

SEQ ID NO: 10433 - RNA, 21 nt, Artificial Sequence
  Synthetic oligonucleotide
uuugggaauacuuuguuuuuu

SEQ ID NO: 10434 - RNA, 21 nt, Artificial Sequence
  Synthetic oligonucleotide
uugggaauacuuuguuuuuua

SEQ ID NO: 10435 - RNA, 21 nt, Artificial Sequence
  Synthetic oligonucleotide
ugggaauacuuuguuuuuuaa

SEQ ID NO: 10436 - RNA, 21 nt, Artificial Sequence
  Synthetic oligonucleotide
gggaauacuuuguuuuuuaau

SEQ ID NO: 10437 - RNA, 21 nt, Artificial Sequence
  Synthetic oligonucleotide
ggaauacuuuguuuuuuaauc

SEQ ID NO: 10438 - RNA, 21 nt, Artificial Sequence
  Synthetic oligonucleotide
gaauacuuuguuuuuuaaucu

SEQ ID NO: 10439 - RNA, 21 nt, Artificial Sequence
  Synthetic oligonucleotide
aauacuuuguuuuuuaaucuu

SEQ ID NO: 10440 - RNA, 21 nt, Artificial Sequence
  Synthetic oligonucleotide
auacuuuguuuuuuaaucuuc

SEQ ID NO: 10441 - RNA, 21 nt, Artificial Sequence
  Synthetic oligonucleotide
uacuuuguuuuuuaaucuucc

SEQ ID NO: 10442 - RNA, 21 nt, Artificial Sequence
  Synthetic oligonucleotide
acuuuguuuuuuaaucuuccu

SEQ ID NO: 10443 - RNA, 21 nt, Artificial Sequence
  Synthetic oligonucleotide
cuuuguuuuuuaaucuuccug

SEQ ID NO: 10444 - RNA, 21 nt, Artificial Sequence
  Synthetic oligonucleotide
uuuguuuuuuaaucuuccugg

SEQ ID NO: 10445 - RNA, 21 nt, Artificial Sequence
  Synthetic oligonucleotide
uuguuuuuuaaucuuccuggg

SEQ ID NO: 10446 - RNA, 21 nt, Artificial Sequence
  Synthetic oligonucleotide
ccuggggacaggagcaaacau

SEQ ID NO: 10447 - RNA, 21 nt, Artificial Sequence
  Synthetic oligonucleotide
cuggggacaggagcaaacaua

SEQ ID NO: 10448 - RNA, 21 nt, Artificial Sequence
  Synthetic oligonucleotide
uggggacaggagcaaacauau

SEQ ID NO: 10449 - RNA, 21 nt, Artificial Sequence
  Synthetic oligonucleotide
ggggacaggagcaaacauaug

SEQ ID NO: 10450 - RNA, 21 nt, Artificial Sequence
  Synthetic oligonucleotide
gggacaggagcaaacauaugu

SEQ ID NO: 10451 - RNA, 21 nt, Artificial Sequence
  Synthetic oligonucleotide
ggacaggagcaaacauauguc

SEQ ID NO: 10452 - RNA, 21 nt, Artificial Sequence
  Synthetic oligonucleotide
gacaggagcaaacauauguca

SEQ ID NO: 10453 - RNA, 21 nt, Artificial Sequence
  Synthetic oligonucleotide
acaggagcaaacauaugucau

SEQ ID NO: 10454 - RNA, 21 nt, Artificial Sequence
  Synthetic oligonucleotide
caggagcaaacauaugucauu

SEQ ID NO: 10455 - RNA, 21 nt, Artificial Sequence
  Synthetic oligonucleotide
aggagcaaacauaugucauuu

SEQ ID NO: 10456 - RNA, 21 nt, Artificial Sequence
  Synthetic oligonucleotide
ggagcaaacauaugucauuuc

SEQ ID NO: 10457 - RNA, 21 nt, Artificial Sequence
  Synthetic oligonucleotide
gagcaaacauaugucauuuca

SEQ ID NO: 10458 - RNA, 21 nt, Artificial Sequence
  Synthetic oligonucleotide
agcaaacauaugucauuucag

SEQ ID NO: 10459 - RNA, 21 nt, Artificial Sequence
  Synthetic oligonucleotide
gcaaacauaugucauuucagc

SEQ ID NO: 10460 - RNA, 21 nt, Artificial Sequence
  Synthetic oligonucleotide
caaacauaugucauuucagca

SEQ ID NO: 10461 - RNA, 21 nt, Artificial Sequence
  Synthetic oligonucleotide
aaacauaugucauuucagcac

SEQ ID NO: 10462 - RNA, 21 nt, Artificial Sequence
  Synthetic oligonucleotide
aacauaugucauuucagcacc

SEQ ID NO: 10463 - RNA, 21 nt, Artificial Sequence
  Synthetic oligonucleotide
cauaugucauuucagcaccaa

SEQ ID NO: 10464 - RNA, 21 nt, Artificial Sequence
  Synthetic oligonucleotide
auaugucauuucagcaccaaa

SEQ ID NO: 10465 - RNA, 21 nt, Artificial Sequence
  Synthetic oligonucleotide
uaugucauuucagcaccaaaa

SEQ ID NO: 10466 - RNA, 21 nt, Artificial Sequence
  Synthetic oligonucleotide
augucauuucagcaccaaaaa

SEQ ID NO: 10467 - RNA, 21 nt, Artificial Sequence
  Synthetic oligonucleotide
ugucauuucagcaccaaaaau

SEQ ID NO: 10468 - RNA, 21 nt, Artificial Sequence
  Synthetic oligonucleotide
gucauuucagcaccaaaaaua

SEQ ID NO: 10469 - RNA, 21 nt, Artificial Sequence
  Synthetic oligonucleotide
ucauuucagcaccaaaaauau

SEQ ID NO: 10470 - RNA, 21 nt, Artificial Sequence
  Synthetic oligonucleotide
cauuucagcaccaaaaauauu

SEQ ID NO: 10471 - RNA, 21 nt, Artificial Sequence
  Synthetic oligonucleotide
auuucagcaccaaaaauauuc

SEQ ID NO: 10472 - RNA, 21 nt, Artificial Sequence
  Synthetic oligonucleotide
uuucagcaccaaaaauauucc

SEQ ID NO: 10473 - RNA, 21 nt, Artificial Sequence
  Synthetic oligonucleotide
uucagcaccaaaaauauuccg

SEQ ID NO: 10474 - RNA, 21 nt, Artificial Sequence
  Synthetic oligonucleotide
ucagcaccaaaaauauuccgu

SEQ ID NO: 10475 - RNA, 21 nt, Artificial Sequence
  Synthetic oligonucleotide
cagcaccaaaaauauuccgug

SEQ ID NO: 10476 - RNA, 21 nt, Artificial Sequence
  Synthetic oligonucleotide
agcaccaaaaauauuccgugu

SEQ ID NO: 10477 - RNA, 21 nt, Artificial Sequence
  Synthetic oligonucleotide
gcaccaaaaauauuccguguu

SEQ ID NO: 10478 - RNA, 21 nt, Artificial Sequence
  Synthetic oligonucleotide
caccaaaaauauuccguguug

SEQ ID NO: 10479 - RNA, 21 nt, Artificial Sequence
  Synthetic oligonucleotide
accaaaaauauuccguguugg

SEQ ID NO: 10480 - RNA, 21 nt, Artificial Sequence
  Synthetic oligonucleotide
ccaaaaauauuccguguugga

SEQ ID NO: 10481 - RNA, 21 nt, Artificial Sequence
  Synthetic oligonucleotide
caaaaauauuccguguuggag

SEQ ID NO: 10482 - RNA, 21 nt, Artificial Sequence
  Synthetic oligonucleotide
aaaaauauuccguguuggagc

SEQ ID NO: 10483 - RNA, 21 nt, Artificial Sequence
  Synthetic oligonucleotide
aaaauauuccguguuggagca

SEQ ID NO: 10484 - RNA, 21 nt, Artificial Sequence
  Synthetic oligonucleotide
aaauauuccguguuggagcau

SEQ ID NO: 10485 - RNA, 21 nt, Artificial Sequence
  Synthetic oligonucleotide
aauauuccguguuggagcauc

SEQ ID NO: 10486 - RNA, 21 nt, Artificial Sequence
  Synthetic oligonucleotide
auauuccguguuggagcaucu

SEQ ID NO: 10487 - RNA, 21 nt, Artificial Sequence
  Synthetic oligonucleotide
uauuccguguuggagcaucug

SEQ ID NO: 10488 - RNA, 21 nt, Artificial Sequence
  Synthetic oligonucleotide
auuccguguuggagcaucuga

SEQ ID NO: 10489 - RNA, 21 nt, Artificial Sequence
  Synthetic oligonucleotide
uuccguguuggagcaucugaa

SEQ ID NO: 10490 - RNA, 21 nt, Artificial Sequence
  Synthetic oligonucleotide
uccguguuggagcaucugaaa

SEQ ID NO: 10491 - RNA, 21 nt, Artificial Sequence
  Synthetic oligonucleotide
ccguguuggagcaucugaaaa

SEQ ID NO: 10492 - RNA, 21 nt, Artificial Sequence
  Synthetic oligonucleotide
aaguuuauggauacacugaag

SEQ ID NO: 10493 - RNA, 21 nt, Artificial Sequence
  Synthetic oligonucleotide
uuuauggauacacugaagcau

SEQ ID NO: 10494 - RNA, 21 nt, Artificial Sequence
  Synthetic oligonucleotide
uauggauacacugaagcauuu

SEQ ID NO: 10495 - RNA, 21 nt, Artificial Sequence
  Synthetic oligonucleotide
acugaagcauuugaugcaaca

SEQ ID NO: 10496 - RNA, 21 nt, Artificial Sequence
  Synthetic oligonucleotide
ugaagcauuugaugcaacaau

SEQ ID NO: 10497 - RNA, 21 nt, Artificial Sequence
  Synthetic oligonucleotide
aagcauuugaugcaacaaucu

SEQ ID NO: 10498 - RNA, 21 nt, Artificial Sequence
  Synthetic oligonucleotide
gcauuugaugcaacaaucucu

SEQ ID NO: 10499 - RNA, 21 nt, Artificial Sequence
  Synthetic oligonucleotide
cauuugaugcaacaaucucua

SEQ ID NO: 10500 - RNA, 21 nt, Artificial Sequence
  Synthetic oligonucleotide
auuugaugcaacaaucucuau

SEQ ID NO: 10501 - RNA, 21 nt, Artificial Sequence
  Synthetic oligonucleotide
augcaacaaucucuauuaaaa

SEQ ID NO: 10502 - RNA, 21 nt, Artificial Sequence
  Synthetic oligonucleotide
ugcaacaaucucuauuaaaag

SEQ ID NO: 10503 - RNA, 21 nt, Artificial Sequence
  Synthetic oligonucleotide
gcaacaaucucuauuaaaagu

SEQ ID NO: 10504 - RNA, 21 nt, Artificial Sequence
  Synthetic oligonucleotide
acaaucucuauuaaaaguuau

SEQ ID NO: 10505 - RNA, 21 nt, Artificial Sequence
  Synthetic oligonucleotide
caaucucuauuaaaaguuauc

SEQ ID NO: 10506 - RNA, 21 nt, Artificial Sequence
  Synthetic oligonucleotide
aaucucuauuaaaaguuaucc

SEQ ID NO: 10507 - RNA, 21 nt, Artificial Sequence
  Synthetic oligonucleotide
aucucuauuaaaaguuauccu

SEQ ID NO: 10508 - RNA, 21 nt, Artificial Sequence
  Synthetic oligonucleotide
ucucuauuaaaaguuauccug

SEQ ID NO: 10509 - RNA, 21 nt, Artificial Sequence
  Synthetic oligonucleotide
ucuauuaaaaguuauccugau

SEQ ID NO: 10510 - RNA, 21 nt, Artificial Sequence
  Synthetic oligonucleotide
uauuaaaaguuauccugauaa

SEQ ID NO: 10511 - RNA, 21 nt, Artificial Sequence
  Synthetic oligonucleotide
auuaaaaguuauccugauaaa

SEQ ID NO: 10512 - RNA, 21 nt, Artificial Sequence
  Synthetic oligonucleotide
aaaaguuauccugauaaaaaa

SEQ ID NO: 10513 - RNA, 21 nt, Artificial Sequence
  Synthetic oligonucleotide
aaaguuauccugauaaaaaau

SEQ ID NO: 10514 - RNA, 21 nt, Artificial Sequence
  Synthetic oligonucleotide
guuauccugauaaaaaauuua

SEQ ID NO: 10515 - RNA, 21 nt, Artificial Sequence
  Synthetic oligonucleotide
uuauccugauaaaaaauuuag

SEQ ID NO: 10516 - RNA, 21 nt, Artificial Sequence
  Synthetic oligonucleotide
uauccugauaaaaaauuuagu

SEQ ID NO: 10517 - RNA, 21 nt, Artificial Sequence
  Synthetic oligonucleotide
auccugauaaaaaauuuaguu

SEQ ID NO: 10518 - RNA, 21 nt, Artificial Sequence
  Synthetic oligonucleotide
uccugauaaaaaauuuaguua

SEQ ID NO: 10519 - RNA, 21 nt, Artificial Sequence
  Synthetic oligonucleotide
ccugauaaaaaauuuaguuac

SEQ ID NO: 10520 - RNA, 21 nt, Artificial Sequence
  Synthetic oligonucleotide
cugauaaaaaauuuaguuacu

SEQ ID NO: 10521 - RNA, 21 nt, Artificial Sequence
  Synthetic oligonucleotide
ugauaaaaaauuuaguuacuc

SEQ ID NO: 10522 - RNA, 21 nt, Artificial Sequence
  Synthetic oligonucleotide
gauaaaaaauuuaguuacucc

SEQ ID NO: 10523 - RNA, 21 nt, Artificial Sequence
  Synthetic oligonucleotide
auaaaaaauuuaguuacuccu

SEQ ID NO: 10524 - RNA, 21 nt, Artificial Sequence
  Synthetic oligonucleotide
uaaaaaauuuaguuacuccuc

SEQ ID NO: 10525 - RNA, 21 nt, Artificial Sequence
  Synthetic oligonucleotide
aaaaaauuuaguuacuccuca

SEQ ID NO: 10526 - RNA, 21 nt, Artificial Sequence
  Synthetic oligonucleotide
aaaaauuuaguuacuccucag

SEQ ID NO: 10527 - RNA, 21 nt, Artificial Sequence
  Synthetic oligonucleotide
aaaauuuaguuacuccucagg

SEQ ID NO: 10528 - RNA, 21 nt, Artificial Sequence
  Synthetic oligonucleotide
aaauuuaguuacuccucaggc

SEQ ID NO: 10529 - RNA, 21 nt, Artificial Sequence
  Synthetic oligonucleotide
aauuuaguuacuccucaggcc

SEQ ID NO: 10530 - RNA, 21 nt, Artificial Sequence
  Synthetic oligonucleotide
auuuaguuacuccucaggcca

SEQ ID NO: 10531 - RNA, 21 nt, Artificial Sequence
  Synthetic oligonucleotide
uuuaguuacuccucaggccau

SEQ ID NO: 10532 - RNA, 21 nt, Artificial Sequence
  Synthetic oligonucleotide
uuaguuacuccucaggccaug

SEQ ID NO: 10533 - RNA, 21 nt, Artificial Sequence
  Synthetic oligonucleotide
uaguuacuccucaggccaugu

SEQ ID NO: 10534 - RNA, 21 nt, Artificial Sequence
  Synthetic oligonucleotide
aguuacuccucaggccauguu

SEQ ID NO: 10535 - RNA, 21 nt, Artificial Sequence
  Synthetic oligonucleotide
guuacuccucaggccauguuc

SEQ ID NO: 10536 - RNA, 21 nt, Artificial Sequence
  Synthetic oligonucleotide
uuacuccucaggccauguuca

SEQ ID NO: 10537 - RNA, 21 nt, Artificial Sequence
  Synthetic oligonucleotide
uacuccucaggccauguucau

SEQ ID NO: 10538 - RNA, 21 nt, Artificial Sequence
  Synthetic oligonucleotide
acuccucaggccauguucauu

SEQ ID NO: 10539 - RNA, 21 nt, Artificial Sequence
  Synthetic oligonucleotide
cuccucaggccauguucauuu

SEQ ID NO: 10540 - RNA, 21 nt, Artificial Sequence
  Synthetic oligonucleotide
uccucaggccauguucauuua

SEQ ID NO: 10541 - RNA, 21 nt, Artificial Sequence
  Synthetic oligonucleotide
ccucaggccauguucauuuau

SEQ ID NO: 10542 - RNA, 21 nt, Artificial Sequence
  Synthetic oligonucleotide
cucaggccauguucauuuauc

SEQ ID NO: 10543 - RNA, 21 nt, Artificial Sequence
  Synthetic oligonucleotide
ucaggccauguucauuuaucc

SEQ ID NO: 10544 - RNA, 21 nt, Artificial Sequence
  Synthetic oligonucleotide
caggccauguucauuuauccu

SEQ ID NO: 10545 - RNA, 21 nt, Artificial Sequence
  Synthetic oligonucleotide
aggccauguucauuuauccuc

SEQ ID NO: 10546 - RNA, 21 nt, Artificial Sequence
  Synthetic oligonucleotide
ggccauguucauuuauccuca

SEQ ID NO: 10547 - RNA, 21 nt, Artificial Sequence
  Synthetic oligonucleotide
gccauguucauuuauccucag

SEQ ID NO: 10548 - RNA, 21 nt, Artificial Sequence
  Synthetic oligonucleotide
ccauguucauuuauccucaga

SEQ ID NO: 10549 - RNA, 21 nt, Artificial Sequence
  Synthetic oligonucleotide
cauguucauuuauccucagag

SEQ ID NO: 10550 - RNA, 21 nt, Artificial Sequence
  Synthetic oligonucleotide
guucauuuauccucagagaau

SEQ ID NO: 10551 - RNA, 21 nt, Artificial Sequence
  Synthetic oligonucleotide
uucauuuauccucagagaaua

SEQ ID NO: 10552 - RNA, 21 nt, Artificial Sequence
  Synthetic oligonucleotide
ucauuuauccucagagaauaa

SEQ ID NO: 10553 - RNA, 21 nt, Artificial Sequence
  Synthetic oligonucleotide
cauuuauccucagagaauaaa

SEQ ID NO: 10554 - RNA, 21 nt, Artificial Sequence
  Synthetic oligonucleotide
auuuauccucagagaauaaau

SEQ ID NO: 10555 - RNA, 21 nt, Artificial Sequence
  Synthetic oligonucleotide
uuuauccucagagaauaaauu

SEQ ID NO: 10556 - RNA, 21 nt, Artificial Sequence
  Synthetic oligonucleotide
uuauccucagagaauaaauuc

SEQ ID NO: 10557 - RNA, 21 nt, Artificial Sequence
  Synthetic oligonucleotide
uauccucagagaauaaauucc

SEQ ID NO: 10558 - RNA, 21 nt, Artificial Sequence
  Synthetic oligonucleotide
auccucagagaauaaauucca

SEQ ID NO: 10559 - RNA, 21 nt, Artificial Sequence
  Synthetic oligonucleotide
uccucagagaauaaauuccaa

SEQ ID NO: 10560 - RNA, 21 nt, Artificial Sequence
  Synthetic oligonucleotide
ccucagagaauaaauuccaaa

SEQ ID NO: 10561 - RNA, 21 nt, Artificial Sequence
  Synthetic oligonucleotide
cucagagaauaaauuccaaaa

SEQ ID NO: 10562 - RNA, 21 nt, Artificial Sequence
  Synthetic oligonucleotide
ucagagaauaaauuccaaaac

SEQ ID NO: 10563 - RNA, 21 nt, Artificial Sequence
  Synthetic oligonucleotide
cagagaauaaauuccaaaacu

SEQ ID NO: 10564 - RNA, 21 nt, Artificial Sequence
  Synthetic oligonucleotide
agagaauaaauuccaaaacuc

SEQ ID NO: 10565 - RNA, 21 nt, Artificial Sequence
  Synthetic oligonucleotide
aaucuuaacaauacaaccaaa

SEQ ID NO: 10566 - RNA, 21 nt, Artificial Sequence
  Synthetic oligonucleotide
aucuuaacaauacaaccaaaa

SEQ ID NO: 10567 - RNA, 21 nt, Artificial Sequence
  Synthetic oligonucleotide
ucuuaacaauacaaccaaaac

SEQ ID NO: 10568 - RNA, 21 nt, Artificial Sequence
  Synthetic oligonucleotide
cuuaacaauacaaccaaaaca

SEQ ID NO: 10569 - RNA, 21 nt, Artificial Sequence
  Synthetic oligonucleotide
uuaacaauacaaccaaaacaa

SEQ ID NO: 10570 - RNA, 21 nt, Artificial Sequence
  Synthetic oligonucleotide
uaacaauacaaccaaaacaau

SEQ ID NO: 10571 - RNA, 21 nt, Artificial Sequence
  Synthetic oligonucleotide
aacaauacaaccaaaacaauu

SEQ ID NO: 10572 - RNA, 21 nt, Artificial Sequence
  Synthetic oligonucleotide
guauuuggaaguuguaucaaa

SEQ ID NO: 10573 - RNA, 21 nt, Artificial Sequence
  Synthetic oligonucleotide
uauuuggaaguuguaucaaag

SEQ ID NO: 10574 - RNA, 21 nt, Artificial Sequence
  Synthetic oligonucleotide
uguaucaaagcauuuuucaaa

SEQ ID NO: 10575 - RNA, 21 nt, Artificial Sequence
  Synthetic oligonucleotide
guaucaaagcauuuuucaaaa

SEQ ID NO: 10576 - RNA, 21 nt, Artificial Sequence
  Synthetic oligonucleotide
uaucaaagcauuuuucaaaau

SEQ ID NO: 10577 - RNA, 21 nt, Artificial Sequence
  Synthetic oligonucleotide
aucaaagcauuuuucaaaauc

SEQ ID NO: 10578 - RNA, 21 nt, Artificial Sequence
  Synthetic oligonucleotide
ucaaagcauuuuucaaaauca

SEQ ID NO: 10579 - RNA, 21 nt, Artificial Sequence
  Synthetic oligonucleotide
ugccaauaaccuaugacaaug

SEQ ID NO: 10580 - RNA, 21 nt, Artificial Sequence
  Synthetic oligonucleotide
gccaauaaccuaugacaaugg

SEQ ID NO: 10581 - RNA, 21 nt, Artificial Sequence
  Synthetic oligonucleotide
caauaaccuaugacaauggau

SEQ ID NO: 10582 - RNA, 21 nt, Artificial Sequence
  Synthetic oligonucleotide
aauaaccuaugacaauggauu

SEQ ID NO: 10583 - RNA, 21 nt, Artificial Sequence
  Synthetic oligonucleotide
auaaccuaugacaauggauuu

SEQ ID NO: 10584 - RNA, 21 nt, Artificial Sequence
  Synthetic oligonucleotide
uaaccuaugacaauggauuuc

SEQ ID NO: 10585 - RNA, 21 nt, Artificial Sequence
  Synthetic oligonucleotide
aaccuaugacaauggauuucu

SEQ ID NO: 10586 - RNA, 21 nt, Artificial Sequence
  Synthetic oligonucleotide
ccuaugacaauggauuucucu

SEQ ID NO: 10587 - RNA, 21 nt, Artificial Sequence
  Synthetic oligonucleotide
cuaugacaauggauuucucuu

SEQ ID NO: 10588 - RNA, 21 nt, Artificial Sequence
  Synthetic oligonucleotide
uaugacaauggauuucucuuc

SEQ ID NO: 10589 - RNA, 21 nt, Artificial Sequence
  Synthetic oligonucleotide
acaauggauuucucuucauuc

SEQ ID NO: 10590 - RNA, 21 nt, Artificial Sequence
  Synthetic oligonucleotide
auggauuucucuucauucaua

SEQ ID NO: 10591 - RNA, 21 nt, Artificial Sequence
  Synthetic oligonucleotide
ggauuucucuucauucauaca

SEQ ID NO: 10592 - RNA, 21 nt, Artificial Sequence
  Synthetic oligonucleotide
gauuucucuucauucauacag

SEQ ID NO: 10593 - RNA, 21 nt, Artificial Sequence
  Synthetic oligonucleotide
auuucucuucauucauacaga

SEQ ID NO: 10594 - RNA, 21 nt, Artificial Sequence
  Synthetic oligonucleotide
uuucucuucauucauacagac

SEQ ID NO: 10595 - RNA, 21 nt, Artificial Sequence
  Synthetic oligonucleotide
uucucuucauucauacagaca

SEQ ID NO: 10596 - RNA, 21 nt, Artificial Sequence
  Synthetic oligonucleotide
ucucuucauucauacagacaa

SEQ ID NO: 10597 - RNA, 21 nt, Artificial Sequence
  Synthetic oligonucleotide
cucuucauucauacagacaaa

SEQ ID NO: 10598 - RNA, 21 nt, Artificial Sequence
  Synthetic oligonucleotide
ucuucauucauacagacaaac

SEQ ID NO: 10599 - RNA, 21 nt, Artificial Sequence
  Synthetic oligonucleotide
cuucauucauacagacaaacc

SEQ ID NO: 10600 - RNA, 21 nt, Artificial Sequence
  Synthetic oligonucleotide
uucauucauacagacaaaccu

SEQ ID NO: 10601 - RNA, 21 nt, Artificial Sequence
  Synthetic oligonucleotide
cauucauacagacaaaccugu

SEQ ID NO: 10602 - RNA, 21 nt, Artificial Sequence
  Synthetic oligonucleotide
cauacagacaaaccuguuuau

SEQ ID NO: 10603 - RNA, 21 nt, Artificial Sequence
  Synthetic oligonucleotide
auacagacaaaccuguuuaua

SEQ ID NO: 10604 - RNA, 21 nt, Artificial Sequence
  Synthetic oligonucleotide
uacagacaaaccuguuuauac

SEQ ID NO: 10605 - RNA, 21 nt, Artificial Sequence
  Synthetic oligonucleotide
acagacaaaccuguuuauacu

SEQ ID NO: 10606 - RNA, 21 nt, Artificial Sequence
  Synthetic oligonucleotide
cagacaaaccuguuuauacuc

SEQ ID NO: 10607 - RNA, 21 nt, Artificial Sequence
  Synthetic oligonucleotide
agacaaaccuguuuauacucc

SEQ ID NO: 10608 - RNA, 21 nt, Artificial Sequence
  Synthetic oligonucleotide
gacaaaccuguuuauacucca

SEQ ID NO: 10609 - RNA, 21 nt, Artificial Sequence
  Synthetic oligonucleotide
acaaaccuguuuauacuccag

SEQ ID NO: 10610 - RNA, 21 nt, Artificial Sequence
  Synthetic oligonucleotide
caaaccuguuuauacuccaga

SEQ ID NO: 10611 - RNA, 21 nt, Artificial Sequence
  Synthetic oligonucleotide
aaaccuguuuauacuccagac

SEQ ID NO: 10612 - RNA, 21 nt, Artificial Sequence
  Synthetic oligonucleotide
aaccuguuuauacuccagacc

SEQ ID NO: 10613 - RNA, 21 nt, Artificial Sequence
  Synthetic oligonucleotide
accuguuuauacuccagacca

SEQ ID NO: 10614 - RNA, 21 nt, Artificial Sequence
  Synthetic oligonucleotide
aguuagaguuuauucguugaa

SEQ ID NO: 10615 - RNA, 21 nt, Artificial Sequence
  Synthetic oligonucleotide
guuagaguuuauucguugaau

SEQ ID NO: 10616 - RNA, 21 nt, Artificial Sequence
  Synthetic oligonucleotide
uuagaguuuauucguugaaug

SEQ ID NO: 10617 - RNA, 21 nt, Artificial Sequence
  Synthetic oligonucleotide
uagaguuuauucguugaauga

SEQ ID NO: 10618 - RNA, 21 nt, Artificial Sequence
  Synthetic oligonucleotide
acgacuugaagccagccaaaa

SEQ ID NO: 10619 - RNA, 21 nt, Artificial Sequence
  Synthetic oligonucleotide
cgacuugaagccagccaaaag

SEQ ID NO: 10620 - RNA, 21 nt, Artificial Sequence
  Synthetic oligonucleotide
gacuugaagccagccaaaaga

SEQ ID NO: 10621 - RNA, 21 nt, Artificial Sequence
  Synthetic oligonucleotide
acuugaagccagccaaaagag

SEQ ID NO: 10622 - RNA, 21 nt, Artificial Sequence
  Synthetic oligonucleotide
cuugaagccagccaaaagaga

SEQ ID NO: 10623 - RNA, 21 nt, Artificial Sequence
  Synthetic oligonucleotide
uugaagccagccaaaagagaa

SEQ ID NO: 10624 - RNA, 21 nt, Artificial Sequence
  Synthetic oligonucleotide
ugaagccagccaaaagagaaa

SEQ ID NO: 10625 - RNA, 21 nt, Artificial Sequence
  Synthetic oligonucleotide
gaagccagccaaaagagaaac

SEQ ID NO: 10626 - RNA, 21 nt, Artificial Sequence
  Synthetic oligonucleotide
aagccagccaaaagagaaacu

SEQ ID NO: 10627 - RNA, 21 nt, Artificial Sequence
  Synthetic oligonucleotide
agccagccaaaagagaaacug

SEQ ID NO: 10628 - RNA, 21 nt, Artificial Sequence
  Synthetic oligonucleotide
gccagccaaaagagaaacugu

SEQ ID NO: 10629 - RNA, 21 nt, Artificial Sequence
  Synthetic oligonucleotide
ccagccaaaagagaaacuguc

SEQ ID NO: 10630 - RNA, 21 nt, Artificial Sequence
  Synthetic oligonucleotide
cagccaaaagagaaacugucu

SEQ ID NO: 10631 - RNA, 21 nt, Artificial Sequence
  Synthetic oligonucleotide
agccaaaagagaaacugucuu

SEQ ID NO: 10632 - RNA, 21 nt, Artificial Sequence
  Synthetic oligonucleotide
gccaaaagagaaacugucuua

SEQ ID NO: 10633 - RNA, 21 nt, Artificial Sequence
  Synthetic oligonucleotide
ccaaaagagaaacugucuuaa

SEQ ID NO: 10634 - RNA, 21 nt, Artificial Sequence
  Synthetic oligonucleotide
caaaagagaaacugucuuaac

SEQ ID NO: 10635 - RNA, 21 nt, Artificial Sequence
  Synthetic oligonucleotide
aaaagagaaacugucuuaacu

SEQ ID NO: 10636 - RNA, 21 nt, Artificial Sequence
  Synthetic oligonucleotide
aaagagaaacugucuuaacuu

SEQ ID NO: 10637 - RNA, 21 nt, Artificial Sequence
  Synthetic oligonucleotide
aagagaaacugucuuaacuuu

SEQ ID NO: 10638 - RNA, 21 nt, Artificial Sequence
  Synthetic oligonucleotide
gagaaacugucuuaacuuuca

SEQ ID NO: 10639 - RNA, 21 nt, Artificial Sequence
  Synthetic oligonucleotide
agaaacugucuuaacuuucau

SEQ ID NO: 10640 - RNA, 21 nt, Artificial Sequence
  Synthetic oligonucleotide
gaaacugucuuaacuuucaua

SEQ ID NO: 10641 - RNA, 21 nt, Artificial Sequence
  Synthetic oligonucleotide
acugucuuaacuuucauagau

SEQ ID NO: 10642 - RNA, 21 nt, Artificial Sequence
  Synthetic oligonucleotide
cugucuuaacuuucauagauc

SEQ ID NO: 10643 - RNA, 21 nt, Artificial Sequence
  Synthetic oligonucleotide
ugucuuaacuuucauagaucc

SEQ ID NO: 10644 - RNA, 21 nt, Artificial Sequence
  Synthetic oligonucleotide
gucuuaacuuucauagauccu

SEQ ID NO: 10645 - RNA, 21 nt, Artificial Sequence
  Synthetic oligonucleotide
ucuuaacuuucauagauccug

SEQ ID NO: 10646 - RNA, 21 nt, Artificial Sequence
  Synthetic oligonucleotide
cuuaacuuucauagauccuga

SEQ ID NO: 10647 - RNA, 21 nt, Artificial Sequence
  Synthetic oligonucleotide
uuaacuuucauagauccugaa

SEQ ID NO: 10648 - RNA, 21 nt, Artificial Sequence
  Synthetic oligonucleotide
uaacuuucauagauccugaag

SEQ ID NO: 10649 - RNA, 21 nt, Artificial Sequence
  Synthetic oligonucleotide
aacuuucauagauccugaagg

SEQ ID NO: 10650 - RNA, 21 nt, Artificial Sequence
  Synthetic oligonucleotide
acuuucauagauccugaagga

SEQ ID NO: 10651 - RNA, 21 nt, Artificial Sequence
  Synthetic oligonucleotide
cuuucauagauccugaaggau

SEQ ID NO: 10652 - RNA, 21 nt, Artificial Sequence
  Synthetic oligonucleotide
uuucauagauccugaaggauc

SEQ ID NO: 10653 - RNA, 21 nt, Artificial Sequence
  Synthetic oligonucleotide
uucauagauccugaaggauca

SEQ ID NO: 10654 - RNA, 21 nt, Artificial Sequence
  Synthetic oligonucleotide
ucauagauccugaaggaucag

SEQ ID NO: 10655 - RNA, 21 nt, Artificial Sequence
  Synthetic oligonucleotide
cauagauccugaaggaucaga

SEQ ID NO: 10656 - RNA, 21 nt, Artificial Sequence
  Synthetic oligonucleotide
auagauccugaaggaucagaa

SEQ ID NO: 10657 - RNA, 21 nt, Artificial Sequence
  Synthetic oligonucleotide
aguugacaugguagaagaaau

SEQ ID NO: 10658 - RNA, 21 nt, Artificial Sequence
  Synthetic oligonucleotide
guugacaugguagaagaaauu

SEQ ID NO: 10659 - RNA, 21 nt, Artificial Sequence
  Synthetic oligonucleotide
gacaugguagaagaaauugau

SEQ ID NO: 10660 - RNA, 21 nt, Artificial Sequence
  Synthetic oligonucleotide
acaugguagaagaaauugauc

SEQ ID NO: 10661 - RNA, 21 nt, Artificial Sequence
  Synthetic oligonucleotide
caugguagaagaaauugauca

SEQ ID NO: 10662 - RNA, 21 nt, Artificial Sequence
  Synthetic oligonucleotide
gguagaagaaauugaucauau

SEQ ID NO: 10663 - RNA, 21 nt, Artificial Sequence
  Synthetic oligonucleotide
guagaagaaauugaucauauu

SEQ ID NO: 10664 - RNA, 21 nt, Artificial Sequence
  Synthetic oligonucleotide
uagaagaaauugaucauauug

SEQ ID NO: 10665 - RNA, 21 nt, Artificial Sequence
  Synthetic oligonucleotide
aagaaauugaucauauuggaa

SEQ ID NO: 10666 - RNA, 21 nt, Artificial Sequence
  Synthetic oligonucleotide
agaaauugaucauauuggaau

SEQ ID NO: 10667 - RNA, 21 nt, Artificial Sequence
  Synthetic oligonucleotide
gaaauugaucauauuggaauu

SEQ ID NO: 10668 - RNA, 21 nt, Artificial Sequence
  Synthetic oligonucleotide
aaauugaucauauuggaauua

SEQ ID NO: 10669 - RNA, 21 nt, Artificial Sequence
  Synthetic oligonucleotide
aauugaucauauuggaauuau

SEQ ID NO: 10670 - RNA, 21 nt, Artificial Sequence
  Synthetic oligonucleotide
auugaucauauuggaauuauc

SEQ ID NO: 10671 - RNA, 21 nt, Artificial Sequence
  Synthetic oligonucleotide
uugaucauauuggaauuaucu

SEQ ID NO: 10672 - RNA, 21 nt, Artificial Sequence
  Synthetic oligonucleotide
ugaucauauuggaauuaucuc

SEQ ID NO: 10673 - RNA, 21 nt, Artificial Sequence
  Synthetic oligonucleotide
gaucauauuggaauuaucucu

SEQ ID NO: 10674 - RNA, 21 nt, Artificial Sequence
  Synthetic oligonucleotide
aucauauuggaauuaucucuu

SEQ ID NO: 10675 - RNA, 21 nt, Artificial Sequence
  Synthetic oligonucleotide
ucauauuggaauuaucucuuu

SEQ ID NO: 10676 - RNA, 21 nt, Artificial Sequence
  Synthetic oligonucleotide
cauauuggaauuaucucuuuu

SEQ ID NO: 10677 - RNA, 21 nt, Artificial Sequence
  Synthetic oligonucleotide
auauuggaauuaucucuuuuc

SEQ ID NO: 10678 - RNA, 21 nt, Artificial Sequence
  Synthetic oligonucleotide
uauuggaauuaucucuuuucc

SEQ ID NO: 10679 - RNA, 21 nt, Artificial Sequence
  Synthetic oligonucleotide
auuggaauuaucucuuuuccu

SEQ ID NO: 10680 - RNA, 21 nt, Artificial Sequence
  Synthetic oligonucleotide
uuuccugacuucaagauuccg

SEQ ID NO: 10681 - RNA, 21 nt, Artificial Sequence
  Synthetic oligonucleotide
uuccugacuucaagauuccgu

SEQ ID NO: 10682 - RNA, 21 nt, Artificial Sequence
  Synthetic oligonucleotide
uccugacuucaagauuccguc

SEQ ID NO: 10683 - RNA, 21 nt, Artificial Sequence
  Synthetic oligonucleotide
ccugacuucaagauuccgucu

SEQ ID NO: 10684 - RNA, 21 nt, Artificial Sequence
  Synthetic oligonucleotide
cugacuucaagauuccgucua

SEQ ID NO: 10685 - RNA, 21 nt, Artificial Sequence
  Synthetic oligonucleotide
ugacuucaagauuccgucuaa

SEQ ID NO: 10686 - RNA, 21 nt, Artificial Sequence
  Synthetic oligonucleotide
gacuucaagauuccgucuaau

SEQ ID NO: 10687 - RNA, 21 nt, Artificial Sequence
  Synthetic oligonucleotide
acuucaagauuccgucuaauc

SEQ ID NO: 10688 - RNA, 21 nt, Artificial Sequence
  Synthetic oligonucleotide
cuucaagauuccgucuaaucc

SEQ ID NO: 10689 - RNA, 21 nt, Artificial Sequence
  Synthetic oligonucleotide
uucaagauuccgucuaauccu

SEQ ID NO: 10690 - RNA, 21 nt, Artificial Sequence
  Synthetic oligonucleotide
ucaagauuccgucuaauccua

SEQ ID NO: 10691 - RNA, 21 nt, Artificial Sequence
  Synthetic oligonucleotide
caagauuccgucuaauccuag

SEQ ID NO: 10692 - RNA, 21 nt, Artificial Sequence
  Synthetic oligonucleotide
aagauuccgucuaauccuaga

SEQ ID NO: 10693 - RNA, 21 nt, Artificial Sequence
  Synthetic oligonucleotide
agauuccgucuaauccuagau

SEQ ID NO: 10694 - RNA, 21 nt, Artificial Sequence
  Synthetic oligonucleotide
gauuccgucuaauccuagaua

SEQ ID NO: 10695 - RNA, 21 nt, Artificial Sequence
  Synthetic oligonucleotide
auuccgucuaauccuagauau

SEQ ID NO: 10696 - RNA, 21 nt, Artificial Sequence
  Synthetic oligonucleotide
uuccgucuaauccuagauaug

SEQ ID NO: 10697 - RNA, 21 nt, Artificial Sequence
  Synthetic oligonucleotide
uccgucuaauccuagauaugg

SEQ ID NO: 10698 - RNA, 21 nt, Artificial Sequence
  Synthetic oligonucleotide
ccgucuaauccuagauauggu

SEQ ID NO: 10699 - RNA, 21 nt, Artificial Sequence
  Synthetic oligonucleotide
cgucuaauccuagauauggua

SEQ ID NO: 10700 - RNA, 21 nt, Artificial Sequence
  Synthetic oligonucleotide
gucuaauccuagauaugguau

SEQ ID NO: 10701 - RNA, 21 nt, Artificial Sequence
  Synthetic oligonucleotide
ucuaauccuagauaugguaug

SEQ ID NO: 10702 - RNA, 21 nt, Artificial Sequence
  Synthetic oligonucleotide
cuaauccuagauaugguaugu

SEQ ID NO: 10703 - RNA, 21 nt, Artificial Sequence
  Synthetic oligonucleotide
uaauccuagauaugguaugug

SEQ ID NO: 10704 - RNA, 21 nt, Artificial Sequence
  Synthetic oligonucleotide
aauccuagauaugguaugugg

SEQ ID NO: 10705 - RNA, 21 nt, Artificial Sequence
  Synthetic oligonucleotide
auccuagauaugguaugugga

SEQ ID NO: 10706 - RNA, 21 nt, Artificial Sequence
  Synthetic oligonucleotide
caaggcuaaauauaaagagga

SEQ ID NO: 10707 - RNA, 21 nt, Artificial Sequence
  Synthetic oligonucleotide
aaggcuaaauauaaagaggac

SEQ ID NO: 10708 - RNA, 21 nt, Artificial Sequence
  Synthetic oligonucleotide
aggcuaaauauaaagaggacu

SEQ ID NO: 10709 - RNA, 21 nt, Artificial Sequence
  Synthetic oligonucleotide
ggcuaaauauaaagaggacuu

SEQ ID NO: 10710 - RNA, 21 nt, Artificial Sequence
  Synthetic oligonucleotide
gcuaaauauaaagaggacuuu

SEQ ID NO: 10711 - RNA, 21 nt, Artificial Sequence
  Synthetic oligonucleotide
cuaaauauaaagaggacuuuu

SEQ ID NO: 10712 - RNA, 21 nt, Artificial Sequence
  Synthetic oligonucleotide
uaaauauaaagaggacuuuuc

SEQ ID NO: 10713 - RNA, 21 nt, Artificial Sequence
  Synthetic oligonucleotide
aaauauaaagaggacuuuuca

SEQ ID NO: 10714 - RNA, 21 nt, Artificial Sequence
  Synthetic oligonucleotide
aauauaaagaggacuuuucaa

SEQ ID NO: 10715 - RNA, 21 nt, Artificial Sequence
  Synthetic oligonucleotide
auauaaagaggacuuuucaac

SEQ ID NO: 10716 - RNA, 21 nt, Artificial Sequence
  Synthetic oligonucleotide
uauaaagaggacuuuucaaca

SEQ ID NO: 10717 - RNA, 21 nt, Artificial Sequence
  Synthetic oligonucleotide
auaaagaggacuuuucaacaa

SEQ ID NO: 10718 - RNA, 21 nt, Artificial Sequence
  Synthetic oligonucleotide
uaaagaggacuuuucaacaac

SEQ ID NO: 10719 - RNA, 21 nt, Artificial Sequence
  Synthetic oligonucleotide
aaagaggacuuuucaacaacu

SEQ ID NO: 10720 - RNA, 21 nt, Artificial Sequence
  Synthetic oligonucleotide
aagaggacuuuucaacaacug

SEQ ID NO: 10721 - RNA, 21 nt, Artificial Sequence
  Synthetic oligonucleotide
agaggacuuuucaacaacugg

SEQ ID NO: 10722 - RNA, 21 nt, Artificial Sequence
  Synthetic oligonucleotide
gaggacuuuucaacaacugga

SEQ ID NO: 10723 - RNA, 21 nt, Artificial Sequence
  Synthetic oligonucleotide
aggacuuuucaacaacuggaa

SEQ ID NO: 10724 - RNA, 21 nt, Artificial Sequence
  Synthetic oligonucleotide
ggacuuuucaacaacuggaac

SEQ ID NO: 10725 - RNA, 21 nt, Artificial Sequence
  Synthetic oligonucleotide
uauuuugaaguuaaagaauau

SEQ ID NO: 10726 - RNA, 21 nt, Artificial Sequence
  Synthetic oligonucleotide
auuuugaaguuaaagaauaug

SEQ ID NO: 10727 - RNA, 21 nt, Artificial Sequence
  Synthetic oligonucleotide
uuuugaaguuaaagaauaugu

SEQ ID NO: 10728 - RNA, 21 nt, Artificial Sequence
  Synthetic oligonucleotide
uuugaaguuaaagaauauguc

SEQ ID NO: 10729 - RNA, 21 nt, Artificial Sequence
  Synthetic oligonucleotide
uugaaguuaaagaauaugucu

SEQ ID NO: 10730 - RNA, 21 nt, Artificial Sequence
  Synthetic oligonucleotide
ugaaguuaaagaauaugucuu

SEQ ID NO: 10731 - RNA, 21 nt, Artificial Sequence
  Synthetic oligonucleotide
gaaguuaaagaauaugucuug

SEQ ID NO: 10732 - RNA, 21 nt, Artificial Sequence
  Synthetic oligonucleotide
aaguuaaagaauaugucuugc

SEQ ID NO: 10733 - RNA, 21 nt, Artificial Sequence
  Synthetic oligonucleotide
uaaagaauaugucuugccaca

SEQ ID NO: 10734 - RNA, 21 nt, Artificial Sequence
  Synthetic oligonucleotide
aaagaauaugucuugccacau

SEQ ID NO: 10735 - RNA, 21 nt, Artificial Sequence
  Synthetic oligonucleotide
aagaauaugucuugccacauu

SEQ ID NO: 10736 - RNA, 21 nt, Artificial Sequence
  Synthetic oligonucleotide
agaauaugucuugccacauuu

SEQ ID NO: 10737 - RNA, 21 nt, Artificial Sequence
  Synthetic oligonucleotide
gaauaugucuugccacauuuu

SEQ ID NO: 10738 - RNA, 21 nt, Artificial Sequence
  Synthetic oligonucleotide
aauaugucuugccacauuuuu

SEQ ID NO: 10739 - RNA, 21 nt, Artificial Sequence
  Synthetic oligonucleotide
auaugucuugccacauuuuuc

SEQ ID NO: 10740 - RNA, 21 nt, Artificial Sequence
  Synthetic oligonucleotide
uaugucuugccacauuuuucu

SEQ ID NO: 10741 - RNA, 21 nt, Artificial Sequence
  Synthetic oligonucleotide
augucuugccacauuuuucug

SEQ ID NO: 10742 - RNA, 21 nt, Artificial Sequence
  Synthetic oligonucleotide
ugucuugccacauuuuucugu

SEQ ID NO: 10743 - RNA, 21 nt, Artificial Sequence
  Synthetic oligonucleotide
gucuugccacauuuuucuguc

SEQ ID NO: 10744 - RNA, 21 nt, Artificial Sequence
  Synthetic oligonucleotide
ucuugccacauuuuucugucu

SEQ ID NO: 10745 - RNA, 21 nt, Artificial Sequence
  Synthetic oligonucleotide
cuugccacauuuuucugucuc

SEQ ID NO: 10746 - RNA, 21 nt, Artificial Sequence
  Synthetic oligonucleotide
uugccacauuuuucugucuca

SEQ ID NO: 10747 - RNA, 21 nt, Artificial Sequence
  Synthetic oligonucleotide
aagaacuuuaagaauuuugaa

SEQ ID NO: 10748 - RNA, 21 nt, Artificial Sequence
  Synthetic oligonucleotide
agaacuuuaagaauuuugaaa

SEQ ID NO: 10749 - RNA, 21 nt, Artificial Sequence
  Synthetic oligonucleotide
gaacuuuaagaauuuugaaau

SEQ ID NO: 10750 - RNA, 21 nt, Artificial Sequence
  Synthetic oligonucleotide
acuuuaagaauuuugaaauua

SEQ ID NO: 10751 - RNA, 21 nt, Artificial Sequence
  Synthetic oligonucleotide
cuuuaagaauuuugaaauuac

SEQ ID NO: 10752 - RNA, 21 nt, Artificial Sequence
  Synthetic oligonucleotide
uuuaagaauuuugaaauuacu

SEQ ID NO: 10753 - RNA, 21 nt, Artificial Sequence
  Synthetic oligonucleotide
uuaagaauuuugaaauuacua

SEQ ID NO: 10754 - RNA, 21 nt, Artificial Sequence
  Synthetic oligonucleotide
uaagaauuuugaaauuacuau

SEQ ID NO: 10755 - RNA, 21 nt, Artificial Sequence
  Synthetic oligonucleotide
aauuuugaaauuacuauaaaa

SEQ ID NO: 10756 - RNA, 21 nt, Artificial Sequence
  Synthetic oligonucleotide
auuuugaaauuacuauaaaag

SEQ ID NO: 10757 - RNA, 21 nt, Artificial Sequence
  Synthetic oligonucleotide
ugaaauuacuauaaaagcaag

SEQ ID NO: 10758 - RNA, 21 nt, Artificial Sequence
  Synthetic oligonucleotide
gaaauuacuauaaaagcaaga

SEQ ID NO: 10759 - RNA, 21 nt, Artificial Sequence
  Synthetic oligonucleotide
aaauuacuauaaaagcaagau

SEQ ID NO: 10760 - RNA, 21 nt, Artificial Sequence
  Synthetic oligonucleotide
aauuacuauaaaagcaagaua

SEQ ID NO: 10761 - RNA, 21 nt, Artificial Sequence
  Synthetic oligonucleotide
auuacuauaaaagcaagauau

SEQ ID NO: 10762 - RNA, 21 nt, Artificial Sequence
  Synthetic oligonucleotide
uuacuauaaaagcaagauauu

SEQ ID NO: 10763 - RNA, 21 nt, Artificial Sequence
  Synthetic oligonucleotide
uacuauaaaagcaagauauuu

SEQ ID NO: 10764 - RNA, 21 nt, Artificial Sequence
  Synthetic oligonucleotide
acuauaaaagcaagauauuuu

SEQ ID NO: 10765 - RNA, 21 nt, Artificial Sequence
  Synthetic oligonucleotide
cuauaaaagcaagauauuuuu

SEQ ID NO: 10766 - RNA, 21 nt, Artificial Sequence
  Synthetic oligonucleotide
uauaaaagcaagauauuuuua

SEQ ID NO: 10767 - RNA, 21 nt, Artificial Sequence
  Synthetic oligonucleotide
auaaaagcaagauauuuuuau

SEQ ID NO: 10768 - RNA, 21 nt, Artificial Sequence
  Synthetic oligonucleotide
agauauuuuuauaauaaagua

SEQ ID NO: 10769 - RNA, 21 nt, Artificial Sequence
  Synthetic oligonucleotide
gauauuuuuauaauaaaguag

SEQ ID NO: 10770 - RNA, 21 nt, Artificial Sequence
  Synthetic oligonucleotide
auauuuuuauaauaaaguagu

SEQ ID NO: 10771 - RNA, 21 nt, Artificial Sequence
  Synthetic oligonucleotide
uauuuuuauaauaaaguaguc

SEQ ID NO: 10772 - RNA, 21 nt, Artificial Sequence
  Synthetic oligonucleotide
auuuuuauaauaaaguaguca

SEQ ID NO: 10773 - RNA, 21 nt, Artificial Sequence
  Synthetic oligonucleotide
uuuuuauaauaaaguagucac

SEQ ID NO: 10774 - RNA, 21 nt, Artificial Sequence
  Synthetic oligonucleotide
uuuuauaauaaaguagucacu

SEQ ID NO: 10775 - RNA, 21 nt, Artificial Sequence
  Synthetic oligonucleotide
uuuauaauaaaguagucacug

SEQ ID NO: 10776 - RNA, 21 nt, Artificial Sequence
  Synthetic oligonucleotide
uuauaauaaaguagucacuga

SEQ ID NO: 10777 - RNA, 21 nt, Artificial Sequence
  Synthetic oligonucleotide
uauaauaaaguagucacugag

SEQ ID NO: 10778 - RNA, 21 nt, Artificial Sequence
  Synthetic oligonucleotide
auaauaaaguagucacugagg

SEQ ID NO: 10779 - RNA, 21 nt, Artificial Sequence
  Synthetic oligonucleotide
uaauaaaguagucacugaggc

SEQ ID NO: 10780 - RNA, 21 nt, Artificial Sequence
  Synthetic oligonucleotide
aauaaaguagucacugaggcu

SEQ ID NO: 10781 - RNA, 21 nt, Artificial Sequence
  Synthetic oligonucleotide
auaaaguagucacugaggcug

SEQ ID NO: 10782 - RNA, 21 nt, Artificial Sequence
  Synthetic oligonucleotide
uaaaguagucacugaggcuga

SEQ ID NO: 10783 - RNA, 21 nt, Artificial Sequence
  Synthetic oligonucleotide
acguuuauaucacauuuggaa

SEQ ID NO: 10784 - RNA, 21 nt, Artificial Sequence
  Synthetic oligonucleotide
cguuuauaucacauuuggaau

SEQ ID NO: 10785 - RNA, 21 nt, Artificial Sequence
  Synthetic oligonucleotide
guuuauaucacauuuggaaua

SEQ ID NO: 10786 - RNA, 21 nt, Artificial Sequence
  Synthetic oligonucleotide
uuuauaucacauuuggaauaa

SEQ ID NO: 10787 - RNA, 21 nt, Artificial Sequence
  Synthetic oligonucleotide
uuauaucacauuuggaauaag

SEQ ID NO: 10788 - RNA, 21 nt, Artificial Sequence
  Synthetic oligonucleotide
uauaucacauuuggaauaaga

SEQ ID NO: 10789 - RNA, 21 nt, Artificial Sequence
  Synthetic oligonucleotide
auaucacauuuggaauaagag

SEQ ID NO: 10790 - RNA, 21 nt, Artificial Sequence
  Synthetic oligonucleotide
uaucacauuuggaauaagaga

SEQ ID NO: 10791 - RNA, 21 nt, Artificial Sequence
  Synthetic oligonucleotide
aucacauuuggaauaagagaa

SEQ ID NO: 10792 - RNA, 21 nt, Artificial Sequence
  Synthetic oligonucleotide
ucacauuuggaauaagagaag

SEQ ID NO: 10793 - RNA, 21 nt, Artificial Sequence
  Synthetic oligonucleotide
cacauuuggaauaagagaaga

SEQ ID NO: 10794 - RNA, 21 nt, Artificial Sequence
  Synthetic oligonucleotide
acauuuggaauaagagaagac

SEQ ID NO: 10795 - RNA, 21 nt, Artificial Sequence
  Synthetic oligonucleotide
cauuuggaauaagagaagacu

SEQ ID NO: 10796 - RNA, 21 nt, Artificial Sequence
  Synthetic oligonucleotide
auuuggaauaagagaagacuu

SEQ ID NO: 10797 - RNA, 21 nt, Artificial Sequence
  Synthetic oligonucleotide
uuuggaauaagagaagacuua

SEQ ID NO: 10798 - RNA, 21 nt, Artificial Sequence
  Synthetic oligonucleotide
uuggaauaagagaagacuuaa

SEQ ID NO: 10799 - RNA, 21 nt, Artificial Sequence
  Synthetic oligonucleotide
uggaauaagagaagacuuaaa

SEQ ID NO: 10800 - RNA, 21 nt, Artificial Sequence
  Synthetic oligonucleotide
ggaauaagagaagacuuaaaa

SEQ ID NO: 10801 - RNA, 21 nt, Artificial Sequence
  Synthetic oligonucleotide
gaauaagagaagacuuaaaag

SEQ ID NO: 10802 - RNA, 21 nt, Artificial Sequence
  Synthetic oligonucleotide
aauaagagaagacuuaaaaga

SEQ ID NO: 10803 - RNA, 21 nt, Artificial Sequence
  Synthetic oligonucleotide
auaagagaagacuuaaaagau

SEQ ID NO: 10804 - RNA, 21 nt, Artificial Sequence
  Synthetic oligonucleotide
uaagagaagacuuaaaagaug

SEQ ID NO: 10805 - RNA, 21 nt, Artificial Sequence
  Synthetic oligonucleotide
aagagaagacuuaaaagauga

SEQ ID NO: 10806 - RNA, 21 nt, Artificial Sequence
  Synthetic oligonucleotide
agagaagacuuaaaagaugau

SEQ ID NO: 10807 - RNA, 21 nt, Artificial Sequence
  Synthetic oligonucleotide
gagaagacuuaaaagaugauc

SEQ ID NO: 10808 - RNA, 21 nt, Artificial Sequence
  Synthetic oligonucleotide
agaagacuuaaaagaugauca

SEQ ID NO: 10809 - RNA, 21 nt, Artificial Sequence
  Synthetic oligonucleotide
gaagacuuaaaagaugaucaa

SEQ ID NO: 10810 - RNA, 21 nt, Artificial Sequence
  Synthetic oligonucleotide
aagacuuaaaagaugaucaaa

SEQ ID NO: 10811 - RNA, 21 nt, Artificial Sequence
  Synthetic oligonucleotide
agacuuaaaagaugaucaaaa

SEQ ID NO: 10812 - RNA, 21 nt, Artificial Sequence
  Synthetic oligonucleotide
gacuuaaaagaugaucaaaaa

SEQ ID NO: 10813 - RNA, 21 nt, Artificial Sequence
  Synthetic oligonucleotide
acuuaaaagaugaucaaaaag

SEQ ID NO: 10814 - RNA, 21 nt, Artificial Sequence
  Synthetic oligonucleotide
cuuaaaagaugaucaaaaaga

SEQ ID NO: 10815 - RNA, 21 nt, Artificial Sequence
  Synthetic oligonucleotide
uuaaaagaugaucaaaaagaa

SEQ ID NO: 10816 - RNA, 21 nt, Artificial Sequence
  Synthetic oligonucleotide
uaaaagaugaucaaaaagaaa

SEQ ID NO: 10817 - RNA, 21 nt, Artificial Sequence
  Synthetic oligonucleotide
aaaagaugaucaaaaagaaau

SEQ ID NO: 10818 - RNA, 21 nt, Artificial Sequence
  Synthetic oligonucleotide
aaagaugaucaaaaagaaaug

SEQ ID NO: 10819 - RNA, 21 nt, Artificial Sequence
  Synthetic oligonucleotide
aagaugaucaaaaagaaauga

SEQ ID NO: 10820 - RNA, 21 nt, Artificial Sequence
  Synthetic oligonucleotide
agaugaucaaaaagaaaugau

SEQ ID NO: 10821 - RNA, 21 nt, Artificial Sequence
  Synthetic oligonucleotide
gaugaucaaaaagaaaugaug

SEQ ID NO: 10822 - RNA, 21 nt, Artificial Sequence
  Synthetic oligonucleotide
augaucaaaaagaaaugaugc

SEQ ID NO: 10823 - RNA, 21 nt, Artificial Sequence
  Synthetic oligonucleotide
ugaucaaaaagaaaugaugca

SEQ ID NO: 10824 - RNA, 21 nt, Artificial Sequence
  Synthetic oligonucleotide
gaucaaaaagaaaugaugcaa

SEQ ID NO: 10825 - RNA, 21 nt, Artificial Sequence
  Synthetic oligonucleotide
aucaaaaagaaaugaugcaaa

SEQ ID NO: 10826 - RNA, 21 nt, Artificial Sequence
  Synthetic oligonucleotide
ucaaaaagaaaugaugcaaac

SEQ ID NO: 10827 - RNA, 21 nt, Artificial Sequence
  Synthetic oligonucleotide
caaaaagaaaugaugcaaaca

SEQ ID NO: 10828 - RNA, 21 nt, Artificial Sequence
  Synthetic oligonucleotide
aaaaagaaaugaugcaaacag

SEQ ID NO: 10829 - RNA, 21 nt, Artificial Sequence
  Synthetic oligonucleotide
aaaagaaaugaugcaaacagc

SEQ ID NO: 10830 - RNA, 21 nt, Artificial Sequence
  Synthetic oligonucleotide
aaagaaaugaugcaaacagca

SEQ ID NO: 10831 - RNA, 21 nt, Artificial Sequence
  Synthetic oligonucleotide
aagaaaugaugcaaacagcaa

SEQ ID NO: 10832 - RNA, 21 nt, Artificial Sequence
  Synthetic oligonucleotide
agaaaugaugcaaacagcaau

SEQ ID NO: 10833 - RNA, 21 nt, Artificial Sequence
  Synthetic oligonucleotide
gaaaugaugcaaacagcaaug

SEQ ID NO: 10834 - RNA, 21 nt, Artificial Sequence
  Synthetic oligonucleotide
aaaugaugcaaacagcaaugc

SEQ ID NO: 10835 - RNA, 21 nt, Artificial Sequence
  Synthetic oligonucleotide
aaugaugcaaacagcaaugca

SEQ ID NO: 10836 - RNA, 21 nt, Artificial Sequence
  Synthetic oligonucleotide
caauguugauaaauggaauug

SEQ ID NO: 10837 - RNA, 21 nt, Artificial Sequence
  Synthetic oligonucleotide
guugauaaauggaauugcuca

SEQ ID NO: 10838 - RNA, 21 nt, Artificial Sequence
  Synthetic oligonucleotide
uugauaaauggaauugcucaa

SEQ ID NO: 10839 - RNA, 21 nt, Artificial Sequence
  Synthetic oligonucleotide
gauaaauggaauugcucaagu

SEQ ID NO: 10840 - RNA, 21 nt, Artificial Sequence
  Synthetic oligonucleotide
auaaauggaauugcucaaguc

SEQ ID NO: 10841 - RNA, 21 nt, Artificial Sequence
  Synthetic oligonucleotide
uaaauggaauugcucaaguca

SEQ ID NO: 10842 - RNA, 21 nt, Artificial Sequence
  Synthetic oligonucleotide
aauggaauugcucaagucaca

SEQ ID NO: 10843 - RNA, 21 nt, Artificial Sequence
  Synthetic oligonucleotide
auggaauugcucaagucacau

SEQ ID NO: 10844 - RNA, 21 nt, Artificial Sequence
  Synthetic oligonucleotide
uggaauugcucaagucacauu

SEQ ID NO: 10845 - RNA, 21 nt, Artificial Sequence
  Synthetic oligonucleotide
ggaauugcucaagucacauuu

SEQ ID NO: 10846 - RNA, 21 nt, Artificial Sequence
  Synthetic oligonucleotide
gaauugcucaagucacauuug

SEQ ID NO: 10847 - RNA, 21 nt, Artificial Sequence
  Synthetic oligonucleotide
aauugcucaagucacauuuga

SEQ ID NO: 10848 - RNA, 21 nt, Artificial Sequence
  Synthetic oligonucleotide
auugcucaagucacauuugau

SEQ ID NO: 10849 - RNA, 21 nt, Artificial Sequence
  Synthetic oligonucleotide
uugcucaagucacauuugauu

SEQ ID NO: 10850 - RNA, 21 nt, Artificial Sequence
  Synthetic oligonucleotide
gcucaagucacauuugauucu

SEQ ID NO: 10851 - RNA, 21 nt, Artificial Sequence
  Synthetic oligonucleotide
aagucacauuugauucugaaa

SEQ ID NO: 10852 - RNA, 21 nt, Artificial Sequence
  Synthetic oligonucleotide
agucacauuugauucugaaac

SEQ ID NO: 10853 - RNA, 21 nt, Artificial Sequence
  Synthetic oligonucleotide
gucacauuugauucugaaaca

SEQ ID NO: 10854 - RNA, 21 nt, Artificial Sequence
  Synthetic oligonucleotide
ucacauuugauucugaaacag

SEQ ID NO: 10855 - RNA, 21 nt, Artificial Sequence
  Synthetic oligonucleotide
acauuugauucugaaacagca

SEQ ID NO: 10856 - RNA, 21 nt, Artificial Sequence
  Synthetic oligonucleotide
uuugauucugaaacagcaguc

SEQ ID NO: 10857 - RNA, 21 nt, Artificial Sequence
  Synthetic oligonucleotide
uugauucugaaacagcaguca

SEQ ID NO: 10858 - RNA, 21 nt, Artificial Sequence
  Synthetic oligonucleotide
ugauucugaaacagcagucaa

SEQ ID NO: 10859 - RNA, 21 nt, Artificial Sequence
  Synthetic oligonucleotide
gauucugaaacagcagucaaa

SEQ ID NO: 10860 - RNA, 21 nt, Artificial Sequence
  Synthetic oligonucleotide
auucugaaacagcagucaaag

SEQ ID NO: 10861 - RNA, 21 nt, Artificial Sequence
  Synthetic oligonucleotide
uucugaaacagcagucaaaga

SEQ ID NO: 10862 - RNA, 21 nt, Artificial Sequence
  Synthetic oligonucleotide
ucugaaacagcagucaaagaa

SEQ ID NO: 10863 - RNA, 21 nt, Artificial Sequence
  Synthetic oligonucleotide
cugaaacagcagucaaagaac

SEQ ID NO: 10864 - RNA, 21 nt, Artificial Sequence
  Synthetic oligonucleotide
ugaaacagcagucaaagaacu

SEQ ID NO: 10865 - RNA, 21 nt, Artificial Sequence
  Synthetic oligonucleotide
gaaacagcagucaaagaacug

SEQ ID NO: 10866 - RNA, 21 nt, Artificial Sequence
  Synthetic oligonucleotide
aaacagcagucaaagaacugu

SEQ ID NO: 10867 - RNA, 21 nt, Artificial Sequence
  Synthetic oligonucleotide
acagcagucaaagaacuguca

SEQ ID NO: 10868 - RNA, 21 nt, Artificial Sequence
  Synthetic oligonucleotide
agcagucaaagaacugucaua

SEQ ID NO: 10869 - RNA, 21 nt, Artificial Sequence
  Synthetic oligonucleotide
gcagucaaagaacugucauac

SEQ ID NO: 10870 - RNA, 21 nt, Artificial Sequence
  Synthetic oligonucleotide
agucaaagaacugucauacua

SEQ ID NO: 10871 - RNA, 21 nt, Artificial Sequence
  Synthetic oligonucleotide
gucaaagaacugucauacuac

SEQ ID NO: 10872 - RNA, 21 nt, Artificial Sequence
  Synthetic oligonucleotide
ucaaagaacugucauacuaca

SEQ ID NO: 10873 - RNA, 21 nt, Artificial Sequence
  Synthetic oligonucleotide
aagaacugucauacuacaguu

SEQ ID NO: 10874 - RNA, 21 nt, Artificial Sequence
  Synthetic oligonucleotide
gaacugucauacuacaguuua

SEQ ID NO: 10875 - RNA, 21 nt, Artificial Sequence
  Synthetic oligonucleotide
aacugucauacuacaguuuag

SEQ ID NO: 10876 - RNA, 21 nt, Artificial Sequence
  Synthetic oligonucleotide
acugucauacuacaguuuaga

SEQ ID NO: 10877 - RNA, 21 nt, Artificial Sequence
  Synthetic oligonucleotide
cugucauacuacaguuuagaa

SEQ ID NO: 10878 - RNA, 21 nt, Artificial Sequence
  Synthetic oligonucleotide
ugucauacuacaguuuagaag

SEQ ID NO: 10879 - RNA, 21 nt, Artificial Sequence
  Synthetic oligonucleotide
gucauacuacaguuuagaaga

SEQ ID NO: 10880 - RNA, 21 nt, Artificial Sequence
  Synthetic oligonucleotide
ucauacuacaguuuagaagau

SEQ ID NO: 10881 - RNA, 21 nt, Artificial Sequence
  Synthetic oligonucleotide
cauacuacaguuuagaagauu

SEQ ID NO: 10882 - RNA, 21 nt, Artificial Sequence
  Synthetic oligonucleotide
auacuacaguuuagaagauuu

SEQ ID NO: 10883 - RNA, 21 nt, Artificial Sequence
  Synthetic oligonucleotide
uacuacaguuuagaagauuua

SEQ ID NO: 10884 - RNA, 21 nt, Artificial Sequence
  Synthetic oligonucleotide
acuacaguuuagaagauuuaa

SEQ ID NO: 10885 - RNA, 21 nt, Artificial Sequence
  Synthetic oligonucleotide
cuacaguuuagaagauuuaaa

SEQ ID NO: 10886 - RNA, 21 nt, Artificial Sequence
  Synthetic oligonucleotide
uacaguuuagaagauuuaaac

SEQ ID NO: 10887 - RNA, 21 nt, Artificial Sequence
  Synthetic oligonucleotide
acaguuuagaagauuuaaaca

SEQ ID NO: 10888 - RNA, 21 nt, Artificial Sequence
  Synthetic oligonucleotide
caguuuagaagauuuaaacaa

SEQ ID NO: 10889 - RNA, 21 nt, Artificial Sequence
  Synthetic oligonucleotide
aguuuagaagauuuaaacaac

SEQ ID NO: 10890 - RNA, 21 nt, Artificial Sequence
  Synthetic oligonucleotide
guuuagaagauuuaaacaaca

SEQ ID NO: 10891 - RNA, 21 nt, Artificial Sequence
  Synthetic oligonucleotide
uuuagaagauuuaaacaacaa

SEQ ID NO: 10892 - RNA, 21 nt, Artificial Sequence
  Synthetic oligonucleotide
uuagaagauuuaaacaacaag

SEQ ID NO: 10893 - RNA, 21 nt, Artificial Sequence
  Synthetic oligonucleotide
uagaagauuuaaacaacaagu

SEQ ID NO: 10894 - RNA, 21 nt, Artificial Sequence
  Synthetic oligonucleotide
agaagauuuaaacaacaagua

SEQ ID NO: 10895 - RNA, 21 nt, Artificial Sequence
  Synthetic oligonucleotide
gaagauuuaaacaacaaguac

SEQ ID NO: 10896 - RNA, 21 nt, Artificial Sequence
  Synthetic oligonucleotide
aagauuuaaacaacaaguacc

SEQ ID NO: 10897 - RNA, 21 nt, Artificial Sequence
  Synthetic oligonucleotide
agauuuaaacaacaaguaccu

SEQ ID NO: 10898 - RNA, 21 nt, Artificial Sequence
  Synthetic oligonucleotide
gauuuaaacaacaaguaccuu

SEQ ID NO: 10899 - RNA, 21 nt, Artificial Sequence
  Synthetic oligonucleotide
aguaccuuuauauugcuguaa

SEQ ID NO: 10900 - RNA, 21 nt, Artificial Sequence
  Synthetic oligonucleotide
uaccuuuauauugcuguaaca

SEQ ID NO: 10901 - RNA, 21 nt, Artificial Sequence
  Synthetic oligonucleotide
accuuuauauugcuguaacag

SEQ ID NO: 10902 - RNA, 21 nt, Artificial Sequence
  Synthetic oligonucleotide
ccuuuauauugcuguaacagu

SEQ ID NO: 10903 - RNA, 21 nt, Artificial Sequence
  Synthetic oligonucleotide
cuuuauauugcuguaacaguc

SEQ ID NO: 10904 - RNA, 21 nt, Artificial Sequence
  Synthetic oligonucleotide
uuuauauugcuguaacaguca

SEQ ID NO: 10905 - RNA, 21 nt, Artificial Sequence
  Synthetic oligonucleotide
uuauauugcuguaacagucau

SEQ ID NO: 10906 - RNA, 21 nt, Artificial Sequence
  Synthetic oligonucleotide
uauauugcuguaacagucaua

SEQ ID NO: 10907 - RNA, 21 nt, Artificial Sequence
  Synthetic oligonucleotide
auauugcuguaacagucauag

SEQ ID NO: 10908 - RNA, 21 nt, Artificial Sequence
  Synthetic oligonucleotide
uauugcuguaacagucauaga

SEQ ID NO: 10909 - RNA, 21 nt, Artificial Sequence
  Synthetic oligonucleotide
auugcuguaacagucauagag

SEQ ID NO: 10910 - RNA, 21 nt, Artificial Sequence
  Synthetic oligonucleotide
uugcuguaacagucauagagu

SEQ ID NO: 10911 - RNA, 21 nt, Artificial Sequence
  Synthetic oligonucleotide
ugcuguaacagucauagaguc

SEQ ID NO: 10912 - RNA, 21 nt, Artificial Sequence
  Synthetic oligonucleotide
gcuguaacagucauagagucu

SEQ ID NO: 10913 - RNA, 21 nt, Artificial Sequence
  Synthetic oligonucleotide
cuguaacagucauagagucua

SEQ ID NO: 10914 - RNA, 21 nt, Artificial Sequence
  Synthetic oligonucleotide
uguaacagucauagagucuac

SEQ ID NO: 10915 - RNA, 21 nt, Artificial Sequence
  Synthetic oligonucleotide
guaacagucauagagucuaca

SEQ ID NO: 10916 - RNA, 21 nt, Artificial Sequence
  Synthetic oligonucleotide
uaacagucauagagucuacag

SEQ ID NO: 10917 - RNA, 21 nt, Artificial Sequence
  Synthetic oligonucleotide
aacagucauagagucuacagg

SEQ ID NO: 10918 - RNA, 21 nt, Artificial Sequence
  Synthetic oligonucleotide
acagucauagagucuacaggu

SEQ ID NO: 10919 - RNA, 21 nt, Artificial Sequence
  Synthetic oligonucleotide
cagucauagagucuacaggug

SEQ ID NO: 10920 - RNA, 21 nt, Artificial Sequence
  Synthetic oligonucleotide
agucauagagucuacaggugg

SEQ ID NO: 10921 - RNA, 21 nt, Artificial Sequence
  Synthetic oligonucleotide
gucauagagucuacaggugga

SEQ ID NO: 10922 - RNA, 21 nt, Artificial Sequence
  Synthetic oligonucleotide
ucauagagucuacagguggau

SEQ ID NO: 10923 - RNA, 21 nt, Artificial Sequence
  Synthetic oligonucleotide
cauagagucuacagguggauu

SEQ ID NO: 10924 - RNA, 21 nt, Artificial Sequence
  Synthetic oligonucleotide
auagagucuacagguggauuu

SEQ ID NO: 10925 - RNA, 21 nt, Artificial Sequence
  Synthetic oligonucleotide
uagagucuacagguggauuuu

SEQ ID NO: 10926 - RNA, 21 nt, Artificial Sequence
  Synthetic oligonucleotide
agagucuacagguggauuuuc

SEQ ID NO: 10927 - RNA, 21 nt, Artificial Sequence
  Synthetic oligonucleotide
gagucuacagguggauuuucu

SEQ ID NO: 10928 - RNA, 21 nt, Artificial Sequence
  Synthetic oligonucleotide
agucuacagguggauuuucug

SEQ ID NO: 10929 - RNA, 21 nt, Artificial Sequence
  Synthetic oligonucleotide
gucuacagguggauuuucuga

SEQ ID NO: 10930 - RNA, 21 nt, Artificial Sequence
  Synthetic oligonucleotide
ucuacagguggauuuucugaa

SEQ ID NO: 10931 - RNA, 21 nt, Artificial Sequence
  Synthetic oligonucleotide
cuacagguggauuuucugaag

SEQ ID NO: 10932 - RNA, 21 nt, Artificial Sequence
  Synthetic oligonucleotide
uacagguggauuuucugaaga

SEQ ID NO: 10933 - RNA, 21 nt, Artificial Sequence
  Synthetic oligonucleotide
acagguggauuuucugaagag

SEQ ID NO: 10934 - RNA, 21 nt, Artificial Sequence
  Synthetic oligonucleotide
cagguggauuuucugaagagg

SEQ ID NO: 10935 - RNA, 21 nt, Artificial Sequence
  Synthetic oligonucleotide
agguggauuuucugaagaggc

SEQ ID NO: 10936 - RNA, 21 nt, Artificial Sequence
  Synthetic oligonucleotide
gguggauuuucugaagaggca

SEQ ID NO: 10937 - RNA, 21 nt, Artificial Sequence
  Synthetic oligonucleotide
guggauuuucugaagaggcag

SEQ ID NO: 10938 - RNA, 21 nt, Artificial Sequence
  Synthetic oligonucleotide
uggauuuucugaagaggcaga

SEQ ID NO: 10939 - RNA, 21 nt, Artificial Sequence
  Synthetic oligonucleotide
ggauuuucugaagaggcagaa

SEQ ID NO: 10940 - RNA, 21 nt, Artificial Sequence
  Synthetic oligonucleotide
gauuuucugaagaggcagaaa

SEQ ID NO: 10941 - RNA, 21 nt, Artificial Sequence
  Synthetic oligonucleotide
auuuucugaagaggcagaaau

SEQ ID NO: 10942 - RNA, 21 nt, Artificial Sequence
  Synthetic oligonucleotide
uuuucugaagaggcagaaaua

SEQ ID NO: 10943 - RNA, 21 nt, Artificial Sequence
  Synthetic oligonucleotide
uuucugaagaggcagaaauac

SEQ ID NO: 10944 - RNA, 21 nt, Artificial Sequence
  Synthetic oligonucleotide
uucugaagaggcagaaauacc

SEQ ID NO: 10945 - RNA, 21 nt, Artificial Sequence
  Synthetic oligonucleotide
ucugaagaggcagaaauaccu

SEQ ID NO: 10946 - RNA, 21 nt, Artificial Sequence
  Synthetic oligonucleotide
cugaagaggcagaaauaccug

SEQ ID NO: 10947 - RNA, 21 nt, Artificial Sequence
  Synthetic oligonucleotide
ugaagaggcagaaauaccugg

SEQ ID NO: 10948 - RNA, 21 nt, Artificial Sequence
  Synthetic oligonucleotide
gaagaggcagaaauaccuggc

SEQ ID NO: 10949 - RNA, 21 nt, Artificial Sequence
  Synthetic oligonucleotide
aagaggcagaaauaccuggca

SEQ ID NO: 10950 - RNA, 21 nt, Artificial Sequence
  Synthetic oligonucleotide
agaggcagaaauaccuggcau

SEQ ID NO: 10951 - RNA, 21 nt, Artificial Sequence
  Synthetic oligonucleotide
gaggcagaaauaccuggcauc

SEQ ID NO: 10952 - RNA, 21 nt, Artificial Sequence
  Synthetic oligonucleotide
aggcagaaauaccuggcauca

SEQ ID NO: 10953 - RNA, 21 nt, Artificial Sequence
  Synthetic oligonucleotide
ggcagaaauaccuggcaucaa

SEQ ID NO: 10954 - RNA, 21 nt, Artificial Sequence
  Synthetic oligonucleotide
gcagaaauaccuggcaucaaa

SEQ ID NO: 10955 - RNA, 21 nt, Artificial Sequence
  Synthetic oligonucleotide
cagaaauaccuggcaucaaau

SEQ ID NO: 10956 - RNA, 21 nt, Artificial Sequence
  Synthetic oligonucleotide
agaaauaccuggcaucaaaua

SEQ ID NO: 10957 - RNA, 21 nt, Artificial Sequence
  Synthetic oligonucleotide
gaaauaccuggcaucaaauau

SEQ ID NO: 10958 - RNA, 21 nt, Artificial Sequence
  Synthetic oligonucleotide
aaauaccuggcaucaaauaug

SEQ ID NO: 10959 - RNA, 21 nt, Artificial Sequence
  Synthetic oligonucleotide
aauaccuggcaucaaauaugu

SEQ ID NO: 10960 - RNA, 21 nt, Artificial Sequence
  Synthetic oligonucleotide
auaccuggcaucaaauauguc

SEQ ID NO: 10961 - RNA, 21 nt, Artificial Sequence
  Synthetic oligonucleotide
uaccuggcaucaaauaugucc

SEQ ID NO: 10962 - RNA, 21 nt, Artificial Sequence
  Synthetic oligonucleotide
accuggcaucaaauauguccu

SEQ ID NO: 10963 - RNA, 21 nt, Artificial Sequence
  Synthetic oligonucleotide
ccuggcaucaaauauguccuc

SEQ ID NO: 10964 - RNA, 21 nt, Artificial Sequence
  Synthetic oligonucleotide
cuggcaucaaauauguccucu

SEQ ID NO: 10965 - RNA, 21 nt, Artificial Sequence
  Synthetic oligonucleotide
uggcaucaaauauguccucuc

SEQ ID NO: 10966 - RNA, 21 nt, Artificial Sequence
  Synthetic oligonucleotide
ggcaucaaauauguccucucu

SEQ ID NO: 10967 - RNA, 21 nt, Artificial Sequence
  Synthetic oligonucleotide
gcaucaaauauguccucucuc

SEQ ID NO: 10968 - RNA, 21 nt, Artificial Sequence
  Synthetic oligonucleotide
aucaaauauguccucucuccc

SEQ ID NO: 10969 - RNA, 21 nt, Artificial Sequence
  Synthetic oligonucleotide
ucaaauauguccucucucccu

SEQ ID NO: 10970 - RNA, 21 nt, Artificial Sequence
  Synthetic oligonucleotide
caaauauguccucucucccua

SEQ ID NO: 10971 - RNA, 21 nt, Artificial Sequence
  Synthetic oligonucleotide
aaauauguccucucucccuac

SEQ ID NO: 10972 - RNA, 21 nt, Artificial Sequence
  Synthetic oligonucleotide
aauauguccucucucccuaca

SEQ ID NO: 10973 - RNA, 21 nt, Artificial Sequence
  Synthetic oligonucleotide
auauguccucucucccuacaa

SEQ ID NO: 10974 - RNA, 21 nt, Artificial Sequence
  Synthetic oligonucleotide
uauguccucucucccuacaaa

SEQ ID NO: 10975 - RNA, 21 nt, Artificial Sequence
  Synthetic oligonucleotide
auguccucucucccuacaaac

SEQ ID NO: 10976 - RNA, 21 nt, Artificial Sequence
  Synthetic oligonucleotide
uguccucucucccuacaaacu

SEQ ID NO: 10977 - RNA, 21 nt, Artificial Sequence
  Synthetic oligonucleotide
guccucucucccuacaaacug

SEQ ID NO: 10978 - RNA, 21 nt, Artificial Sequence
  Synthetic oligonucleotide
uccucucucccuacaaacuga

SEQ ID NO: 10979 - RNA, 21 nt, Artificial Sequence
  Synthetic oligonucleotide
ccucucucccuacaaacugaa

SEQ ID NO: 10980 - RNA, 21 nt, Artificial Sequence
  Synthetic oligonucleotide
cucucucccuacaaacugaau

SEQ ID NO: 10981 - RNA, 21 nt, Artificial Sequence
  Synthetic oligonucleotide
ucucucccuacaaacugaauu

SEQ ID NO: 10982 - RNA, 21 nt, Artificial Sequence
  Synthetic oligonucleotide
cucucccuacaaacugaauuu

SEQ ID NO: 10983 - RNA, 21 nt, Artificial Sequence
  Synthetic oligonucleotide
ucucccuacaaacugaauuug

SEQ ID NO: 10984 - RNA, 21 nt, Artificial Sequence
  Synthetic oligonucleotide
ucccuacaaacugaauuuggu

SEQ ID NO: 10985 - RNA, 21 nt, Artificial Sequence
  Synthetic oligonucleotide
cccuacaaacugaauuugguu

SEQ ID NO: 10986 - RNA, 21 nt, Artificial Sequence
  Synthetic oligonucleotide
ccuacaaacugaauuugguug

SEQ ID NO: 10987 - RNA, 21 nt, Artificial Sequence
  Synthetic oligonucleotide
acaaacugaauuugguugcua

SEQ ID NO: 10988 - RNA, 21 nt, Artificial Sequence
  Synthetic oligonucleotide
caaacugaauuugguugcuac

SEQ ID NO: 10989 - RNA, 21 nt, Artificial Sequence
  Synthetic oligonucleotide
aaacugaauuugguugcuacu

SEQ ID NO: 10990 - RNA, 21 nt, Artificial Sequence
  Synthetic oligonucleotide
aacugaauuugguugcuacuc

SEQ ID NO: 10991 - RNA, 21 nt, Artificial Sequence
  Synthetic oligonucleotide
acugaauuugguugcuacucc

SEQ ID NO: 10992 - RNA, 21 nt, Artificial Sequence
  Synthetic oligonucleotide
cugaauuugguugcuacuccu

SEQ ID NO: 10993 - RNA, 21 nt, Artificial Sequence
  Synthetic oligonucleotide
ugaauuugguugcuacuccuc

SEQ ID NO: 10994 - RNA, 21 nt, Artificial Sequence
  Synthetic oligonucleotide
gaauuugguugcuacuccucu

SEQ ID NO: 10995 - RNA, 21 nt, Artificial Sequence
  Synthetic oligonucleotide
aauuugguugcuacuccucuu

SEQ ID NO: 10996 - RNA, 21 nt, Artificial Sequence
  Synthetic oligonucleotide
auuugguugcuacuccucuuu

SEQ ID NO: 10997 - RNA, 21 nt, Artificial Sequence
  Synthetic oligonucleotide
uuugguugcuacuccucuuuu

SEQ ID NO: 10998 - RNA, 21 nt, Artificial Sequence
  Synthetic oligonucleotide
uugguugcuacuccucuuuuc

SEQ ID NO: 10999 - RNA, 21 nt, Artificial Sequence
  Synthetic oligonucleotide
ugguugcuacuccucuuuucc

SEQ ID NO: 11000 - RNA, 21 nt, Artificial Sequence
  Synthetic oligonucleotide
gguugcuacuccucuuuuccu

SEQ ID NO: 11001 - RNA, 21 nt, Artificial Sequence
  Synthetic oligonucleotide
guugcuacuccucuuuuccug

SEQ ID NO: 11002 - RNA, 21 nt, Artificial Sequence
  Synthetic oligonucleotide
uugcuacuccucuuuuccuga

SEQ ID NO: 11003 - RNA, 21 nt, Artificial Sequence
  Synthetic oligonucleotide
ugcuacuccucuuuuccugaa

SEQ ID NO: 11004 - RNA, 21 nt, Artificial Sequence
  Synthetic oligonucleotide
gcuacuccucuuuuccugaag

SEQ ID NO: 11005 - RNA, 21 nt, Artificial Sequence
  Synthetic oligonucleotide
cuacuccucuuuuccugaagc

SEQ ID NO: 11006 - RNA, 21 nt, Artificial Sequence
  Synthetic oligonucleotide
uacuccucuuuuccugaagcc

SEQ ID NO: 11007 - RNA, 21 nt, Artificial Sequence
  Synthetic oligonucleotide
acuccucuuuuccugaagccu

SEQ ID NO: 11008 - RNA, 21 nt, Artificial Sequence
  Synthetic oligonucleotide
cuccucuuuuccugaagccug

SEQ ID NO: 11009 - RNA, 21 nt, Artificial Sequence
  Synthetic oligonucleotide
uccucuuuuccugaagccugg

SEQ ID NO: 11010 - RNA, 21 nt, Artificial Sequence
  Synthetic oligonucleotide
ccucuuuuccugaagccuggg

SEQ ID NO: 11011 - RNA, 21 nt, Artificial Sequence
  Synthetic oligonucleotide
cucuuuuccugaagccuggga

SEQ ID NO: 11012 - RNA, 21 nt, Artificial Sequence
  Synthetic oligonucleotide
ucuuuuccugaagccugggau

SEQ ID NO: 11013 - RNA, 21 nt, Artificial Sequence
  Synthetic oligonucleotide
cuuuuccugaagccugggauu

SEQ ID NO: 11014 - RNA, 21 nt, Artificial Sequence
  Synthetic oligonucleotide
uuuuccugaagccugggauuc

SEQ ID NO: 11015 - RNA, 21 nt, Artificial Sequence
  Synthetic oligonucleotide
uuuccugaagccugggauucc

SEQ ID NO: 11016 - RNA, 21 nt, Artificial Sequence
  Synthetic oligonucleotide
uuccugaagccugggauucca

SEQ ID NO: 11017 - RNA, 21 nt, Artificial Sequence
  Synthetic oligonucleotide
uccugaagccugggauuccau

SEQ ID NO: 11018 - RNA, 21 nt, Artificial Sequence
  Synthetic oligonucleotide
ccugaagccugggauuccaua

SEQ ID NO: 11019 - RNA, 21 nt, Artificial Sequence
  Synthetic oligonucleotide
cugaagccugggauuccauau

SEQ ID NO: 11020 - RNA, 21 nt, Artificial Sequence
  Synthetic oligonucleotide
ucccaucaaggugcagguuaa

SEQ ID NO: 11021 - RNA, 21 nt, Artificial Sequence
  Synthetic oligonucleotide
cccaucaaggugcagguuaaa

SEQ ID NO: 11022 - RNA, 21 nt, Artificial Sequence
  Synthetic oligonucleotide
ccaucaaggugcagguuaaag

SEQ ID NO: 11023 - RNA, 21 nt, Artificial Sequence
  Synthetic oligonucleotide
caucaaggugcagguuaaaga

SEQ ID NO: 11024 - RNA, 21 nt, Artificial Sequence
  Synthetic oligonucleotide
aucaaggugcagguuaaagau

SEQ ID NO: 11025 - RNA, 21 nt, Artificial Sequence
  Synthetic oligonucleotide
uucgcuugaccaguugguagg

SEQ ID NO: 11026 - RNA, 21 nt, Artificial Sequence
  Synthetic oligonucleotide
ucgcuugaccaguugguagga

SEQ ID NO: 11027 - RNA, 21 nt, Artificial Sequence
  Synthetic oligonucleotide
cgcuugaccaguugguaggag

SEQ ID NO: 11028 - RNA, 21 nt, Artificial Sequence
  Synthetic oligonucleotide
gcuugaccaguugguaggagg

SEQ ID NO: 11029 - RNA, 21 nt, Artificial Sequence
  Synthetic oligonucleotide
gagucccaguaacacugaaug

SEQ ID NO: 11030 - RNA, 21 nt, Artificial Sequence
  Synthetic oligonucleotide
agucccaguaacacugaaugc

SEQ ID NO: 11031 - RNA, 21 nt, Artificial Sequence
  Synthetic oligonucleotide
gucccaguaacacugaaugca

SEQ ID NO: 11032 - RNA, 21 nt, Artificial Sequence
  Synthetic oligonucleotide
ucccaguaacacugaaugcac

SEQ ID NO: 11033 - RNA, 21 nt, Artificial Sequence
  Synthetic oligonucleotide
cccaguaacacugaaugcaca

SEQ ID NO: 11034 - RNA, 21 nt, Artificial Sequence
  Synthetic oligonucleotide
ccaguaacacugaaugcacaa

SEQ ID NO: 11035 - RNA, 21 nt, Artificial Sequence
  Synthetic oligonucleotide
caguaacacugaaugcacaaa

SEQ ID NO: 11036 - RNA, 21 nt, Artificial Sequence
  Synthetic oligonucleotide
aguaacacugaaugcacaaac

SEQ ID NO: 11037 - RNA, 21 nt, Artificial Sequence
  Synthetic oligonucleotide
guaacacugaaugcacaaaca

SEQ ID NO: 11038 - RNA, 21 nt, Artificial Sequence
  Synthetic oligonucleotide
uaacacugaaugcacaaacaa

SEQ ID NO: 11039 - RNA, 21 nt, Artificial Sequence
  Synthetic oligonucleotide
aacacugaaugcacaaacaau

SEQ ID NO: 11040 - RNA, 21 nt, Artificial Sequence
  Synthetic oligonucleotide
acacugaaugcacaaacaauu

SEQ ID NO: 11041 - RNA, 21 nt, Artificial Sequence
  Synthetic oligonucleotide
cugaaugcacaaacaauugau

SEQ ID NO: 11042 - RNA, 21 nt, Artificial Sequence
  Synthetic oligonucleotide
ugaaugcacaaacaauugaug

SEQ ID NO: 11043 - RNA, 21 nt, Artificial Sequence
  Synthetic oligonucleotide
gaaugcacaaacaauugaugu

SEQ ID NO: 11044 - RNA, 21 nt, Artificial Sequence
  Synthetic oligonucleotide
uaaaccaagagacaucugacu

SEQ ID NO: 11045 - RNA, 21 nt, Artificial Sequence
  Synthetic oligonucleotide
aaaccaagagacaucugacuu

SEQ ID NO: 11046 - RNA, 21 nt, Artificial Sequence
  Synthetic oligonucleotide
aaccaagagacaucugacuug

SEQ ID NO: 11047 - RNA, 21 nt, Artificial Sequence
  Synthetic oligonucleotide
gcaaaaguguaacacguguug

SEQ ID NO: 11048 - RNA, 21 nt, Artificial Sequence
  Synthetic oligonucleotide
caaaaguguaacacguguuga

SEQ ID NO: 11049 - RNA, 21 nt, Artificial Sequence
  Synthetic oligonucleotide
aaaaguguaacacguguugau

SEQ ID NO: 11050 - RNA, 21 nt, Artificial Sequence
  Synthetic oligonucleotide
aaaguguaacacguguugaug

SEQ ID NO: 11051 - RNA, 21 nt, Artificial Sequence
  Synthetic oligonucleotide
aaguguaacacguguugauga

SEQ ID NO: 11052 - RNA, 21 nt, Artificial Sequence
  Synthetic oligonucleotide
aguguaacacguguugaugau

SEQ ID NO: 11053 - RNA, 21 nt, Artificial Sequence
  Synthetic oligonucleotide
guguaacacguguugaugaug

SEQ ID NO: 11054 - RNA, 21 nt, Artificial Sequence
  Synthetic oligonucleotide
uguaacacguguugaugaugg

SEQ ID NO: 11055 - RNA, 21 nt, Artificial Sequence
  Synthetic oligonucleotide
guaacacguguugaugaugga

SEQ ID NO: 11056 - RNA, 21 nt, Artificial Sequence
  Synthetic oligonucleotide
uaacacguguugaugauggag

SEQ ID NO: 11057 - RNA, 21 nt, Artificial Sequence
  Synthetic oligonucleotide
aacacguguugaugauggagu

SEQ ID NO: 11058 - RNA, 21 nt, Artificial Sequence
  Synthetic oligonucleotide
acacguguugaugauggagua

SEQ ID NO: 11059 - RNA, 21 nt, Artificial Sequence
  Synthetic oligonucleotide
cacguguugaugauggaguag

SEQ ID NO: 11060 - RNA, 21 nt, Artificial Sequence
  Synthetic oligonucleotide
acguguugaugauggaguagc

SEQ ID NO: 11061 - RNA, 21 nt, Artificial Sequence
  Synthetic oligonucleotide
cguguugaugauggaguagcu

SEQ ID NO: 11062 - RNA, 21 nt, Artificial Sequence
  Synthetic oligonucleotide
guguugaugauggaguagcuu

SEQ ID NO: 11063 - RNA, 21 nt, Artificial Sequence
  Synthetic oligonucleotide
uguugaugauggaguagcuuc

SEQ ID NO: 11064 - RNA, 21 nt, Artificial Sequence
  Synthetic oligonucleotide
gcuuaaucucccaucuggagu

SEQ ID NO: 11065 - RNA, 21 nt, Artificial Sequence
  Synthetic oligonucleotide
cuuaaucucccaucuggagug

SEQ ID NO: 11066 - RNA, 21 nt, Artificial Sequence
  Synthetic oligonucleotide
uuaaucucccaucuggaguga

SEQ ID NO: 11067 - RNA, 21 nt, Artificial Sequence
  Synthetic oligonucleotide
uaaucucccaucuggagugac

SEQ ID NO: 11068 - RNA, 21 nt, Artificial Sequence
  Synthetic oligonucleotide
aaucucccaucuggagugacg

SEQ ID NO: 11069 - RNA, 21 nt, Artificial Sequence
  Synthetic oligonucleotide
ucucccaucuggagugacggu

SEQ ID NO: 11070 - RNA, 21 nt, Artificial Sequence
  Synthetic oligonucleotide
ucccaucuggagugacggugc

SEQ ID NO: 11071 - RNA, 21 nt, Artificial Sequence
  Synthetic oligonucleotide
cccaucuggagugacggugcu

SEQ ID NO: 11072 - RNA, 21 nt, Artificial Sequence
  Synthetic oligonucleotide
ccaucuggagugacggugcug

SEQ ID NO: 11073 - RNA, 21 nt, Artificial Sequence
  Synthetic oligonucleotide
caucuggagugacggugcugg

SEQ ID NO: 11074 - RNA, 21 nt, Artificial Sequence
  Synthetic oligonucleotide
aucuggagugacggugcugga

SEQ ID NO: 11075 - RNA, 21 nt, Artificial Sequence
  Synthetic oligonucleotide
ucuggagugacggugcuggag

SEQ ID NO: 11076 - RNA, 21 nt, Artificial Sequence
  Synthetic oligonucleotide
cuggagugacggugcuggagu

SEQ ID NO: 11077 - RNA, 21 nt, Artificial Sequence
  Synthetic oligonucleotide
uggagugacggugcuggaguu

SEQ ID NO: 11078 - RNA, 21 nt, Artificial Sequence
  Synthetic oligonucleotide
ggagugacggugcuggaguuu

SEQ ID NO: 11079 - RNA, 21 nt, Artificial Sequence
  Synthetic oligonucleotide
gagugacggugcuggaguuua

SEQ ID NO: 11080 - RNA, 21 nt, Artificial Sequence
  Synthetic oligonucleotide
agugacggugcuggaguuuaa

SEQ ID NO: 11081 - RNA, 21 nt, Artificial Sequence
  Synthetic oligonucleotide
gugacggugcuggaguuuaau

SEQ ID NO: 11082 - RNA, 21 nt, Artificial Sequence
  Synthetic oligonucleotide
ugacggugcuggaguuuaaug

SEQ ID NO: 11083 - RNA, 21 nt, Artificial Sequence
  Synthetic oligonucleotide
gacggugcuggaguuuaaugu

SEQ ID NO: 11084 - RNA, 21 nt, Artificial Sequence
  Synthetic oligonucleotide
acggugcuggaguuuaauguc

SEQ ID NO: 11085 - RNA, 21 nt, Artificial Sequence
  Synthetic oligonucleotide
cggugcuggaguuuaauguca

SEQ ID NO: 11086 - RNA, 21 nt, Artificial Sequence
  Synthetic oligonucleotide
ggugcuggaguuuaaugucaa

SEQ ID NO: 11087 - RNA, 21 nt, Artificial Sequence
  Synthetic oligonucleotide
gugcuggaguuuaaugucaaa

SEQ ID NO: 11088 - RNA, 21 nt, Artificial Sequence
  Synthetic oligonucleotide
ugcuggaguuuaaugucaaaa

SEQ ID NO: 11089 - RNA, 21 nt, Artificial Sequence
  Synthetic oligonucleotide
gcuggaguuuaaugucaaaac

SEQ ID NO: 11090 - RNA, 21 nt, Artificial Sequence
  Synthetic oligonucleotide
cuggaguuuaaugucaaaacu

SEQ ID NO: 11091 - RNA, 21 nt, Artificial Sequence
  Synthetic oligonucleotide
uggaguuuaaugucaaaacug

SEQ ID NO: 11092 - RNA, 21 nt, Artificial Sequence
  Synthetic oligonucleotide
ggaguuuaaugucaaaacuga

SEQ ID NO: 11093 - RNA, 21 nt, Artificial Sequence
  Synthetic oligonucleotide
gaguuuaaugucaaaacugau

SEQ ID NO: 11094 - RNA, 21 nt, Artificial Sequence
  Synthetic oligonucleotide
aguuuaaugucaaaacugaug

SEQ ID NO: 11095 - RNA, 21 nt, Artificial Sequence
  Synthetic oligonucleotide
guuuaaugucaaaacugaugc

SEQ ID NO: 11096 - RNA, 21 nt, Artificial Sequence
  Synthetic oligonucleotide
uuuaaugucaaaacugaugcu

SEQ ID NO: 11097 - RNA, 21 nt, Artificial Sequence
  Synthetic oligonucleotide
uuaaugucaaaacugaugcuc

SEQ ID NO: 11098 - RNA, 21 nt, Artificial Sequence
  Synthetic oligonucleotide
uaaugucaaaacugaugcucc

SEQ ID NO: 11099 - RNA, 21 nt, Artificial Sequence
  Synthetic oligonucleotide
aaugucaaaacugaugcucca

SEQ ID NO: 11100 - RNA, 21 nt, Artificial Sequence
  Synthetic oligonucleotide
augucaaaacugaugcuccag

SEQ ID NO: 11101 - RNA, 21 nt, Artificial Sequence
  Synthetic oligonucleotide
ugucaaaacugaugcuccaga

SEQ ID NO: 11102 - RNA, 21 nt, Artificial Sequence
  Synthetic oligonucleotide
gucaaaacugaugcuccagau

SEQ ID NO: 11103 - RNA, 21 nt, Artificial Sequence
  Synthetic oligonucleotide
ucaaaacugaugcuccagauc

SEQ ID NO: 11104 - RNA, 21 nt, Artificial Sequence
  Synthetic oligonucleotide
caaaacugaugcuccagaucu

SEQ ID NO: 11105 - RNA, 21 nt, Artificial Sequence
  Synthetic oligonucleotide
aaaacugaugcuccagaucuu

SEQ ID NO: 11106 - RNA, 21 nt, Artificial Sequence
  Synthetic oligonucleotide
aaacugaugcuccagaucuuc

SEQ ID NO: 11107 - RNA, 21 nt, Artificial Sequence
  Synthetic oligonucleotide
aacugaugcuccagaucuucc

SEQ ID NO: 11108 - RNA, 21 nt, Artificial Sequence
  Synthetic oligonucleotide
acugaugcuccagaucuucca

SEQ ID NO: 11109 - RNA, 21 nt, Artificial Sequence
  Synthetic oligonucleotide
cugaugcuccagaucuuccag

SEQ ID NO: 11110 - RNA, 21 nt, Artificial Sequence
  Synthetic oligonucleotide
ugaugcuccagaucuuccaga

SEQ ID NO: 11111 - RNA, 21 nt, Artificial Sequence
  Synthetic oligonucleotide
aagaaaaucaggccagggaag

SEQ ID NO: 11112 - RNA, 21 nt, Artificial Sequence
  Synthetic oligonucleotide
agaaaaucaggccagggaagg

SEQ ID NO: 11113 - RNA, 21 nt, Artificial Sequence
  Synthetic oligonucleotide
gaaaaucaggccagggaaggu

SEQ ID NO: 11114 - RNA, 21 nt, Artificial Sequence
  Synthetic oligonucleotide
aaaaucaggccagggaagguu

SEQ ID NO: 11115 - RNA, 21 nt, Artificial Sequence
  Synthetic oligonucleotide
aaaucaggccagggaagguua

SEQ ID NO: 11116 - RNA, 21 nt, Artificial Sequence
  Synthetic oligonucleotide
aaucaggccagggaagguuac

SEQ ID NO: 11117 - RNA, 21 nt, Artificial Sequence
  Synthetic oligonucleotide
aucaggccagggaagguuacc

SEQ ID NO: 11118 - RNA, 21 nt, Artificial Sequence
  Synthetic oligonucleotide
ucaggccagggaagguuaccg

SEQ ID NO: 11119 - RNA, 21 nt, Artificial Sequence
  Synthetic oligonucleotide
caggccagggaagguuaccga

SEQ ID NO: 11120 - RNA, 21 nt, Artificial Sequence
  Synthetic oligonucleotide
aggccagggaagguuaccgag

SEQ ID NO: 11121 - RNA, 21 nt, Artificial Sequence
  Synthetic oligonucleotide
ggccagggaagguuaccgagc

SEQ ID NO: 11122 - RNA, 21 nt, Artificial Sequence
  Synthetic oligonucleotide
gccagggaagguuaccgagca

SEQ ID NO: 11123 - RNA, 21 nt, Artificial Sequence
  Synthetic oligonucleotide
ccagggaagguuaccgagcaa

SEQ ID NO: 11124 - RNA, 21 nt, Artificial Sequence
  Synthetic oligonucleotide
cagggaagguuaccgagcaau

SEQ ID NO: 11125 - RNA, 21 nt, Artificial Sequence
  Synthetic oligonucleotide
agggaagguuaccgagcaaua

SEQ ID NO: 11126 - RNA, 21 nt, Artificial Sequence
  Synthetic oligonucleotide
gggaagguuaccgagcaauag

SEQ ID NO: 11127 - RNA, 21 nt, Artificial Sequence
  Synthetic oligonucleotide
ggaagguuaccgagcaauagc

SEQ ID NO: 11128 - RNA, 21 nt, Artificial Sequence
  Synthetic oligonucleotide
gaagguuaccgagcaauagca

SEQ ID NO: 11129 - RNA, 21 nt, Artificial Sequence
  Synthetic oligonucleotide
agguuaccgagcaauagcaua

SEQ ID NO: 11130 - RNA, 21 nt, Artificial Sequence
  Synthetic oligonucleotide
gguuaccgagcaauagcauac

SEQ ID NO: 11131 - RNA, 21 nt, Artificial Sequence
  Synthetic oligonucleotide
guuaccgagcaauagcauacu

SEQ ID NO: 11132 - RNA, 21 nt, Artificial Sequence
  Synthetic oligonucleotide
uuaccgagcaauagcauacuc

SEQ ID NO: 11133 - RNA, 21 nt, Artificial Sequence
  Synthetic oligonucleotide
uaccgagcaauagcauacuca

SEQ ID NO: 11134 - RNA, 21 nt, Artificial Sequence
  Synthetic oligonucleotide
accgagcaauagcauacucau

SEQ ID NO: 11135 - RNA, 21 nt, Artificial Sequence
  Synthetic oligonucleotide
ccgagcaauagcauacucauc

SEQ ID NO: 11136 - RNA, 21 nt, Artificial Sequence
  Synthetic oligonucleotide
cgagcaauagcauacucaucu

SEQ ID NO: 11137 - RNA, 21 nt, Artificial Sequence
  Synthetic oligonucleotide
gagcaauagcauacucaucuc

SEQ ID NO: 11138 - RNA, 21 nt, Artificial Sequence
  Synthetic oligonucleotide
agcaauagcauacucaucucu

SEQ ID NO: 11139 - RNA, 21 nt, Artificial Sequence
  Synthetic oligonucleotide
gcaauagcauacucaucucuc

SEQ ID NO: 11140 - RNA, 21 nt, Artificial Sequence
  Synthetic oligonucleotide
caauagcauacucaucucuca

SEQ ID NO: 11141 - RNA, 21 nt, Artificial Sequence
  Synthetic oligonucleotide
aauagcauacucaucucucag

SEQ ID NO: 11142 - RNA, 21 nt, Artificial Sequence
  Synthetic oligonucleotide
auagcauacucaucucucagc

SEQ ID NO: 11143 - RNA, 21 nt, Artificial Sequence
  Synthetic oligonucleotide
uagcauacucaucucucagcc

SEQ ID NO: 11144 - RNA, 21 nt, Artificial Sequence
  Synthetic oligonucleotide
agcauacucaucucucagcca

SEQ ID NO: 11145 - RNA, 21 nt, Artificial Sequence
  Synthetic oligonucleotide
gcauacucaucucucagccaa

SEQ ID NO: 11146 - RNA, 21 nt, Artificial Sequence
  Synthetic oligonucleotide
cauacucaucucucagccaaa

SEQ ID NO: 11147 - RNA, 21 nt, Artificial Sequence
  Synthetic oligonucleotide
auacucaucucucagccaaag

SEQ ID NO: 11148 - RNA, 21 nt, Artificial Sequence
  Synthetic oligonucleotide
uacucaucucucagccaaagu

SEQ ID NO: 11149 - RNA, 21 nt, Artificial Sequence
  Synthetic oligonucleotide
acucaucucucagccaaaguu

SEQ ID NO: 11150 - RNA, 21 nt, Artificial Sequence
  Synthetic oligonucleotide
cucaucucucagccaaaguua

SEQ ID NO: 11151 - RNA, 21 nt, Artificial Sequence
  Synthetic oligonucleotide
ucaucucucagccaaaguuac

SEQ ID NO: 11152 - RNA, 21 nt, Artificial Sequence
  Synthetic oligonucleotide
caucucucagccaaaguuacc

SEQ ID NO: 11153 - RNA, 21 nt, Artificial Sequence
  Synthetic oligonucleotide
aucucucagccaaaguuaccu

SEQ ID NO: 11154 - RNA, 21 nt, Artificial Sequence
  Synthetic oligonucleotide
ucucucagccaaaguuaccuu

SEQ ID NO: 11155 - RNA, 21 nt, Artificial Sequence
  Synthetic oligonucleotide
cucucagccaaaguuaccuuu

SEQ ID NO: 11156 - RNA, 21 nt, Artificial Sequence
  Synthetic oligonucleotide
auaaggcuuugcuagugggag

SEQ ID NO: 11157 - RNA, 21 nt, Artificial Sequence
  Synthetic oligonucleotide
uaaggcuuugcuagugggaga

SEQ ID NO: 11158 - RNA, 21 nt, Artificial Sequence
  Synthetic oligonucleotide
aaggcuuugcuagugggagaa

SEQ ID NO: 11159 - RNA, 21 nt, Artificial Sequence
  Synthetic oligonucleotide
ccccaaaagcccauauauuga

SEQ ID NO: 11160 - RNA, 21 nt, Artificial Sequence
  Synthetic oligonucleotide
cccaaaagcccauauauugac

SEQ ID NO: 11161 - RNA, 21 nt, Artificial Sequence
  Synthetic oligonucleotide
caaaagcccauauauugacaa

SEQ ID NO: 11162 - RNA, 21 nt, Artificial Sequence
  Synthetic oligonucleotide
aaaagcccauauauugacaaa

SEQ ID NO: 11163 - RNA, 21 nt, Artificial Sequence
  Synthetic oligonucleotide
aaagcccauauauugacaaaa

SEQ ID NO: 11164 - RNA, 21 nt, Artificial Sequence
  Synthetic oligonucleotide
gcccauauauugacaaaauaa

SEQ ID NO: 11165 - RNA, 21 nt, Artificial Sequence
  Synthetic oligonucleotide
auauauugacaaaauaacuca

SEQ ID NO: 11166 - RNA, 21 nt, Artificial Sequence
  Synthetic oligonucleotide
uauauugacaaaauaacucac

SEQ ID NO: 11167 - RNA, 21 nt, Artificial Sequence
  Synthetic oligonucleotide
uauugacaaaauaacucacua

SEQ ID NO: 11168 - RNA, 21 nt, Artificial Sequence
  Synthetic oligonucleotide
auuacuugauuuuauccaagg

SEQ ID NO: 11169 - RNA, 21 nt, Artificial Sequence
  Synthetic oligonucleotide
uuacuugauuuuauccaaggg

SEQ ID NO: 11170 - RNA, 21 nt, Artificial Sequence
  Synthetic oligonucleotide
uacuugauuuuauccaagggc

SEQ ID NO: 11171 - RNA, 21 nt, Artificial Sequence
  Synthetic oligonucleotide
acuugauuuuauccaagggca

SEQ ID NO: 11172 - RNA, 21 nt, Artificial Sequence
  Synthetic oligonucleotide
cuugauuuuauccaagggcaa

SEQ ID NO: 11173 - RNA, 21 nt, Artificial Sequence
  Synthetic oligonucleotide
uugauuuuauccaagggcaaa

SEQ ID NO: 11174 - RNA, 21 nt, Artificial Sequence
  Synthetic oligonucleotide
ugauuuuauccaagggcaaaa

SEQ ID NO: 11175 - RNA, 21 nt, Artificial Sequence
  Synthetic oligonucleotide
gauuuuauccaagggcaaaau

SEQ ID NO: 11176 - RNA, 21 nt, Artificial Sequence
  Synthetic oligonucleotide
auuuuauccaagggcaaaauu

SEQ ID NO: 11177 - RNA, 21 nt, Artificial Sequence
  Synthetic oligonucleotide
uuuuauccaagggcaaaauua

SEQ ID NO: 11178 - RNA, 21 nt, Artificial Sequence
  Synthetic oligonucleotide
uuuauccaagggcaaaauuau

SEQ ID NO: 11179 - RNA, 21 nt, Artificial Sequence
  Synthetic oligonucleotide
uuauccaagggcaaaauuauc

SEQ ID NO: 11180 - RNA, 21 nt, Artificial Sequence
  Synthetic oligonucleotide
uauccaagggcaaaauuaucc

SEQ ID NO: 11181 - RNA, 21 nt, Artificial Sequence
  Synthetic oligonucleotide
auccaagggcaaaauuaucca

SEQ ID NO: 11182 - RNA, 21 nt, Artificial Sequence
  Synthetic oligonucleotide
uccaagggcaaaauuauccac

SEQ ID NO: 11183 - RNA, 21 nt, Artificial Sequence
  Synthetic oligonucleotide
ccaagggcaaaauuauccacu

SEQ ID NO: 11184 - RNA, 21 nt, Artificial Sequence
  Synthetic oligonucleotide
caagggcaaaauuauccacuu

SEQ ID NO: 11185 - RNA, 21 nt, Artificial Sequence
  Synthetic oligonucleotide
aagggcaaaauuauccacuuu

SEQ ID NO: 11186 - RNA, 21 nt, Artificial Sequence
  Synthetic oligonucleotide
agggcaaaauuauccacuuug

SEQ ID NO: 11187 - RNA, 21 nt, Artificial Sequence
  Synthetic oligonucleotide
gggcaaaauuauccacuuugg

SEQ ID NO: 11188 - RNA, 21 nt, Artificial Sequence
  Synthetic oligonucleotide
ggcaaaauuauccacuuuggc

SEQ ID NO: 11189 - RNA, 21 nt, Artificial Sequence
  Synthetic oligonucleotide
gcaaaauuauccacuuuggca

SEQ ID NO: 11190 - RNA, 21 nt, Artificial Sequence
  Synthetic oligonucleotide
caaaauuauccacuuuggcac

SEQ ID NO: 11191 - RNA, 21 nt, Artificial Sequence
  Synthetic oligonucleotide
auuuucagaugcaucuuauca

SEQ ID NO: 11192 - RNA, 21 nt, Artificial Sequence
  Synthetic oligonucleotide
uuuucagaugcaucuuaucaa

SEQ ID NO: 11193 - RNA, 21 nt, Artificial Sequence
  Synthetic oligonucleotide
uuucagaugcaucuuaucaaa

SEQ ID NO: 11194 - RNA, 21 nt, Artificial Sequence
  Synthetic oligonucleotide
uucagaugcaucuuaucaaag

SEQ ID NO: 11195 - RNA, 21 nt, Artificial Sequence
  Synthetic oligonucleotide
ucagaugcaucuuaucaaagu

SEQ ID NO: 11196 - RNA, 21 nt, Artificial Sequence
  Synthetic oligonucleotide
cagaugcaucuuaucaaagua

SEQ ID NO: 11197 - RNA, 21 nt, Artificial Sequence
  Synthetic oligonucleotide
agaugcaucuuaucaaaguau

SEQ ID NO: 11198 - RNA, 21 nt, Artificial Sequence
  Synthetic oligonucleotide
gaugcaucuuaucaaaguaua

SEQ ID NO: 11199 - RNA, 21 nt, Artificial Sequence
  Synthetic oligonucleotide
augcaucuuaucaaaguauaa

SEQ ID NO: 11200 - RNA, 21 nt, Artificial Sequence
  Synthetic oligonucleotide
ugcaucuuaucaaaguauaaa

SEQ ID NO: 11201 - RNA, 21 nt, Artificial Sequence
  Synthetic oligonucleotide
gcaucuuaucaaaguauaaac

SEQ ID NO: 11202 - RNA, 21 nt, Artificial Sequence
  Synthetic oligonucleotide
caucuuaucaaaguauaaaca

SEQ ID NO: 11203 - RNA, 21 nt, Artificial Sequence
  Synthetic oligonucleotide
aucuuaucaaaguauaaacau

SEQ ID NO: 11204 - RNA, 21 nt, Artificial Sequence
  Synthetic oligonucleotide
ucuuaucaaaguauaaacauu

SEQ ID NO: 11205 - RNA, 21 nt, Artificial Sequence
  Synthetic oligonucleotide
cuuaucaaaguauaaacauuc

SEQ ID NO: 11206 - RNA, 21 nt, Artificial Sequence
  Synthetic oligonucleotide
uuaucaaaguauaaacauucc

SEQ ID NO: 11207 - RNA, 21 nt, Artificial Sequence
  Synthetic oligonucleotide
uaucaaaguauaaacauucca

SEQ ID NO: 11208 - RNA, 21 nt, Artificial Sequence
  Synthetic oligonucleotide
aucaaaguauaaacauuccag

SEQ ID NO: 11209 - RNA, 21 nt, Artificial Sequence
  Synthetic oligonucleotide
cacagaacaugguuccuucau

SEQ ID NO: 11210 - RNA, 21 nt, Artificial Sequence
  Synthetic oligonucleotide
acagaacaugguuccuucauc

SEQ ID NO: 11211 - RNA, 21 nt, Artificial Sequence
  Synthetic oligonucleotide
cagaacaugguuccuucaucc

SEQ ID NO: 11212 - RNA, 21 nt, Artificial Sequence
  Synthetic oligonucleotide
agaacaugguuccuucauccc

SEQ ID NO: 11213 - RNA, 21 nt, Artificial Sequence
  Synthetic oligonucleotide
gaacaugguuccuucaucccg

SEQ ID NO: 11214 - RNA, 21 nt, Artificial Sequence
  Synthetic oligonucleotide
aacaugguuccuucaucccga

SEQ ID NO: 11215 - RNA, 21 nt, Artificial Sequence
  Synthetic oligonucleotide
acaugguuccuucaucccgac

SEQ ID NO: 11216 - RNA, 21 nt, Artificial Sequence
  Synthetic oligonucleotide
caugguuccuucaucccgacu

SEQ ID NO: 11217 - RNA, 21 nt, Artificial Sequence
  Synthetic oligonucleotide
uucuggucuauuacaucguca

SEQ ID NO: 11218 - RNA, 21 nt, Artificial Sequence
  Synthetic oligonucleotide
ucuggucuauuacaucgucac

SEQ ID NO: 11219 - RNA, 21 nt, Artificial Sequence
  Synthetic oligonucleotide
cuggucuauuacaucgucaca

SEQ ID NO: 11220 - RNA, 21 nt, Artificial Sequence
  Synthetic oligonucleotide
uggucuauuacaucgucacag

SEQ ID NO: 11221 - RNA, 21 nt, Artificial Sequence
  Synthetic oligonucleotide
ggucuauuacaucgucacagg

SEQ ID NO: 11222 - RNA, 21 nt, Artificial Sequence
  Synthetic oligonucleotide
gucuauuacaucgucacagga

SEQ ID NO: 11223 - RNA, 21 nt, Artificial Sequence
  Synthetic oligonucleotide
ucuauuacaucgucacaggag

SEQ ID NO: 11224 - RNA, 21 nt, Artificial Sequence
  Synthetic oligonucleotide
cuauuacaucgucacaggaga

SEQ ID NO: 11225 - RNA, 21 nt, Artificial Sequence
  Synthetic oligonucleotide
aacagacagcagaauuagugu

SEQ ID NO: 11226 - RNA, 21 nt, Artificial Sequence
  Synthetic oligonucleotide
acagacagcagaauuaguguc

SEQ ID NO: 11227 - RNA, 21 nt, Artificial Sequence
  Synthetic oligonucleotide
cagacagcagaauuagugucu

SEQ ID NO: 11228 - RNA, 21 nt, Artificial Sequence
  Synthetic oligonucleotide
agacagcagaauuagugucug

SEQ ID NO: 11229 - RNA, 21 nt, Artificial Sequence
  Synthetic oligonucleotide
gacagcagaauuagugucuga

SEQ ID NO: 11230 - RNA, 21 nt, Artificial Sequence
  Synthetic oligonucleotide
acagcagaauuagugucugau

SEQ ID NO: 11231 - RNA, 21 nt, Artificial Sequence
  Synthetic oligonucleotide
cagcagaauuagugucugauu

SEQ ID NO: 11232 - RNA, 21 nt, Artificial Sequence
  Synthetic oligonucleotide
agcagaauuagugucugauuc

SEQ ID NO: 11233 - RNA, 21 nt, Artificial Sequence
  Synthetic oligonucleotide
gcagaauuagugucugauuca

SEQ ID NO: 11234 - RNA, 21 nt, Artificial Sequence
  Synthetic oligonucleotide
cagaauuagugucugauucag

SEQ ID NO: 11235 - RNA, 21 nt, Artificial Sequence
  Synthetic oligonucleotide
agaauuagugucugauucagu

SEQ ID NO: 11236 - RNA, 21 nt, Artificial Sequence
  Synthetic oligonucleotide
gaauuagugucugauucaguc

SEQ ID NO: 11237 - RNA, 21 nt, Artificial Sequence
  Synthetic oligonucleotide
aauuagugucugauucagucu

SEQ ID NO: 11238 - RNA, 21 nt, Artificial Sequence
  Synthetic oligonucleotide
auuagugucugauucagucug

SEQ ID NO: 11239 - RNA, 21 nt, Artificial Sequence
  Synthetic oligonucleotide
uuagugucugauucagucugg

SEQ ID NO: 11240 - RNA, 21 nt, Artificial Sequence
  Synthetic oligonucleotide
uagugucugauucagucuggu

SEQ ID NO: 11241 - RNA, 21 nt, Artificial Sequence
  Synthetic oligonucleotide
agugucugauucagucugguu

SEQ ID NO: 11242 - RNA, 21 nt, Artificial Sequence
  Synthetic oligonucleotide
ugucugauucagucugguuaa

SEQ ID NO: 11243 - RNA, 21 nt, Artificial Sequence
  Synthetic oligonucleotide
gauucagucugguuaaauauu

SEQ ID NO: 11244 - RNA, 21 nt, Artificial Sequence
  Synthetic oligonucleotide
ugguuaaauauugaagaaaaa

SEQ ID NO: 11245 - RNA, 21 nt, Artificial Sequence
  Synthetic oligonucleotide
gguuaaauauugaagaaaaau

SEQ ID NO: 11246 - RNA, 21 nt, Artificial Sequence
  Synthetic oligonucleotide
guuaaauauugaagaaaaaug

SEQ ID NO: 11247 - RNA, 21 nt, Artificial Sequence
  Synthetic oligonucleotide
uuaaauauugaagaaaaaugu

SEQ ID NO: 11248 - RNA, 21 nt, Artificial Sequence
  Synthetic oligonucleotide
uaaauauugaagaaaaaugug

SEQ ID NO: 11249 - RNA, 21 nt, Artificial Sequence
  Synthetic oligonucleotide
aaauauugaagaaaaaugugg

SEQ ID NO: 11250 - RNA, 21 nt, Artificial Sequence
  Synthetic oligonucleotide
aauauugaagaaaaauguggc

SEQ ID NO: 11251 - RNA, 21 nt, Artificial Sequence
  Synthetic oligonucleotide
auauugaagaaaaauguggca

SEQ ID NO: 11252 - RNA, 21 nt, Artificial Sequence
  Synthetic oligonucleotide
uauugaagaaaaauguggcaa

SEQ ID NO: 11253 - RNA, 21 nt, Artificial Sequence
  Synthetic oligonucleotide
auugaagaaaaauguggcaac

SEQ ID NO: 11254 - RNA, 21 nt, Artificial Sequence
  Synthetic oligonucleotide
uugaagaaaaauguggcaacc

SEQ ID NO: 11255 - RNA, 21 nt, Artificial Sequence
  Synthetic oligonucleotide
ugaagaaaaauguggcaacca

SEQ ID NO: 11256 - RNA, 21 nt, Artificial Sequence
  Synthetic oligonucleotide
gaagaaaaauguggcaaccag

SEQ ID NO: 11257 - RNA, 21 nt, Artificial Sequence
  Synthetic oligonucleotide
aagaaaaauguggcaaccagc

SEQ ID NO: 11258 - RNA, 21 nt, Artificial Sequence
  Synthetic oligonucleotide
agaaaaauguggcaaccagcu

SEQ ID NO: 11259 - RNA, 21 nt, Artificial Sequence
  Synthetic oligonucleotide
gaaaaauguggcaaccagcuc

SEQ ID NO: 11260 - RNA, 21 nt, Artificial Sequence
  Synthetic oligonucleotide
aaaaauguggcaaccagcucc

SEQ ID NO: 11261 - RNA, 21 nt, Artificial Sequence
  Synthetic oligonucleotide
aaaauguggcaaccagcucca

SEQ ID NO: 11262 - RNA, 21 nt, Artificial Sequence
  Synthetic oligonucleotide
aaauguggcaaccagcuccag

SEQ ID NO: 11263 - RNA, 21 nt, Artificial Sequence
  Synthetic oligonucleotide
uguggcaaccagcuccagguu

SEQ ID NO: 11264 - RNA, 21 nt, Artificial Sequence
  Synthetic oligonucleotide
guggcaaccagcuccagguuc

SEQ ID NO: 11265 - RNA, 21 nt, Artificial Sequence
  Synthetic oligonucleotide
uggcaaccagcuccagguuca

SEQ ID NO: 11266 - RNA, 21 nt, Artificial Sequence
  Synthetic oligonucleotide
ggcaaccagcuccagguucau

SEQ ID NO: 11267 - RNA, 21 nt, Artificial Sequence
  Synthetic oligonucleotide
gcaaccagcuccagguucauc

SEQ ID NO: 11268 - RNA, 21 nt, Artificial Sequence
  Synthetic oligonucleotide
caaccagcuccagguucaucu

SEQ ID NO: 11269 - RNA, 21 nt, Artificial Sequence
  Synthetic oligonucleotide
aaccagcuccagguucaucug

SEQ ID NO: 11270 - RNA, 21 nt, Artificial Sequence
  Synthetic oligonucleotide
accagcuccagguucaucugu

SEQ ID NO: 11271 - RNA, 21 nt, Artificial Sequence
  Synthetic oligonucleotide
ccagcuccagguucaucuguc

SEQ ID NO: 11272 - RNA, 21 nt, Artificial Sequence
  Synthetic oligonucleotide
cagcuccagguucaucugucu

SEQ ID NO: 11273 - RNA, 21 nt, Artificial Sequence
  Synthetic oligonucleotide
agcuccagguucaucugucuc

SEQ ID NO: 11274 - RNA, 21 nt, Artificial Sequence
  Synthetic oligonucleotide
gcuccagguucaucugucucc

SEQ ID NO: 11275 - RNA, 21 nt, Artificial Sequence
  Synthetic oligonucleotide
cuccagguucaucugucuccu

SEQ ID NO: 11276 - RNA, 21 nt, Artificial Sequence
  Synthetic oligonucleotide
uccagguucaucugucuccug

SEQ ID NO: 11277 - RNA, 21 nt, Artificial Sequence
  Synthetic oligonucleotide
ccagguucaucugucuccuga

SEQ ID NO: 11278 - RNA, 21 nt, Artificial Sequence
  Synthetic oligonucleotide
cagguucaucugucuccugau

SEQ ID NO: 11279 - RNA, 21 nt, Artificial Sequence
  Synthetic oligonucleotide
agguucaucugucuccugaug

SEQ ID NO: 11280 - RNA, 21 nt, Artificial Sequence
  Synthetic oligonucleotide
gguucaucugucuccugaugc

SEQ ID NO: 11281 - RNA, 21 nt, Artificial Sequence
  Synthetic oligonucleotide
guucaucugucuccugaugca

SEQ ID NO: 11282 - RNA, 21 nt, Artificial Sequence
  Synthetic oligonucleotide
uucaucugucuccugaugcag

SEQ ID NO: 11283 - RNA, 21 nt, Artificial Sequence
  Synthetic oligonucleotide
ucaucugucuccugaugcaga

SEQ ID NO: 11284 - RNA, 21 nt, Artificial Sequence
  Synthetic oligonucleotide
caucugucuccugaugcagau

SEQ ID NO: 11285 - RNA, 21 nt, Artificial Sequence
  Synthetic oligonucleotide
gaauggauuccuggguggcau

SEQ ID NO: 11286 - RNA, 21 nt, Artificial Sequence
  Synthetic oligonucleotide
aauggauuccuggguggcauu

SEQ ID NO: 11287 - RNA, 21 nt, Artificial Sequence
  Synthetic oligonucleotide
auggauuccuggguggcauua

SEQ ID NO: 11288 - RNA, 21 nt, Artificial Sequence
  Synthetic oligonucleotide
aggagccaaaaagcccuugga

SEQ ID NO: 11289 - RNA, 21 nt, Artificial Sequence
  Synthetic oligonucleotide
ggagccaaaaagcccuuggaa

SEQ ID NO: 11290 - RNA, 21 nt, Artificial Sequence
  Synthetic oligonucleotide
gagccaaaaagcccuuggaaa

SEQ ID NO: 11291 - RNA, 21 nt, Artificial Sequence
  Synthetic oligonucleotide
agccaaaaagcccuuggaaag

SEQ ID NO: 11292 - RNA, 21 nt, Artificial Sequence
  Synthetic oligonucleotide
gccaaaaagcccuuggaaaga

SEQ ID NO: 11293 - RNA, 21 nt, Artificial Sequence
  Synthetic oligonucleotide
ccaaaaagcccuuggaaagag

SEQ ID NO: 11294 - RNA, 21 nt, Artificial Sequence
  Synthetic oligonucleotide
caaaaagcccuuggaaagagu

SEQ ID NO: 11295 - RNA, 21 nt, Artificial Sequence
  Synthetic oligonucleotide
aaaaagcccuuggaaagagua

SEQ ID NO: 11296 - RNA, 21 nt, Artificial Sequence
  Synthetic oligonucleotide
aaaagcccuuggaaagaguau

SEQ ID NO: 11297 - RNA, 21 nt, Artificial Sequence
  Synthetic oligonucleotide
aaagcccuuggaaagaguauu

SEQ ID NO: 11298 - RNA, 21 nt, Artificial Sequence
  Synthetic oligonucleotide
aagcccuuggaaagaguauuu

SEQ ID NO: 11299 - RNA, 21 nt, Artificial Sequence
  Synthetic oligonucleotide
agcccuuggaaagaguauuuc

SEQ ID NO: 11300 - RNA, 21 nt, Artificial Sequence
  Synthetic oligonucleotide
gcccuuggaaagaguauuuca

SEQ ID NO: 11301 - RNA, 21 nt, Artificial Sequence
  Synthetic oligonucleotide
cccuuggaaagaguauuucaa

SEQ ID NO: 11302 - RNA, 21 nt, Artificial Sequence
  Synthetic oligonucleotide
ccuuggaaagaguauuucaau

SEQ ID NO: 11303 - RNA, 21 nt, Artificial Sequence
  Synthetic oligonucleotide
cuuggaaagaguauuucaauu

SEQ ID NO: 11304 - RNA, 21 nt, Artificial Sequence
  Synthetic oligonucleotide
uuggaaagaguauuucaauuc

SEQ ID NO: 11305 - RNA, 21 nt, Artificial Sequence
  Synthetic oligonucleotide
uggaaagaguauuucaauucu

SEQ ID NO: 11306 - RNA, 21 nt, Artificial Sequence
  Synthetic oligonucleotide
ggaaagaguauuucaauucuu

SEQ ID NO: 11307 - RNA, 21 nt, Artificial Sequence
  Synthetic oligonucleotide
gaaagaguauuucaauucuua

SEQ ID NO: 11308 - RNA, 21 nt, Artificial Sequence
  Synthetic oligonucleotide
aaagaguauuucaauucuuag

SEQ ID NO: 11309 - RNA, 21 nt, Artificial Sequence
  Synthetic oligonucleotide
aagaguauuucaauucuuaga

SEQ ID NO: 11310 - RNA, 21 nt, Artificial Sequence
  Synthetic oligonucleotide
agaguauuucaauucuuagag

SEQ ID NO: 11311 - RNA, 21 nt, Artificial Sequence
  Synthetic oligonucleotide
gaguauuucaauucuuagaga

SEQ ID NO: 11312 - RNA, 21 nt, Artificial Sequence
  Synthetic oligonucleotide
aguauuucaauucuuagagaa

SEQ ID NO: 11313 - RNA, 21 nt, Artificial Sequence
  Synthetic oligonucleotide
guauuucaauucuuagagaag

SEQ ID NO: 11314 - RNA, 21 nt, Artificial Sequence
  Synthetic oligonucleotide
uauuucaauucuuagagaaga

SEQ ID NO: 11315 - RNA, 21 nt, Artificial Sequence
  Synthetic oligonucleotide
auuucaauucuuagagaagag

SEQ ID NO: 11316 - RNA, 21 nt, Artificial Sequence
  Synthetic oligonucleotide
uuucaauucuuagagaagagu

SEQ ID NO: 11317 - RNA, 21 nt, Artificial Sequence
  Synthetic oligonucleotide
uucaauucuuagagaagagug

SEQ ID NO: 11318 - RNA, 21 nt, Artificial Sequence
  Synthetic oligonucleotide
ucaauucuuagagaagaguga

SEQ ID NO: 11319 - RNA, 21 nt, Artificial Sequence
  Synthetic oligonucleotide
caauucuuagagaagagugau

SEQ ID NO: 11320 - RNA, 21 nt, Artificial Sequence
  Synthetic oligonucleotide
aauucuuagagaagagugauc

SEQ ID NO: 11321 - RNA, 21 nt, Artificial Sequence
  Synthetic oligonucleotide
uucuuagagaagagugaucug

SEQ ID NO: 11322 - RNA, 21 nt, Artificial Sequence
  Synthetic oligonucleotide
ucuuagagaagagugaucugg

SEQ ID NO: 11323 - RNA, 21 nt, Artificial Sequence
  Synthetic oligonucleotide
uuagagaagagugaucugggc

SEQ ID NO: 11324 - RNA, 21 nt, Artificial Sequence
  Synthetic oligonucleotide
uguggggcaggugguggccuc

SEQ ID NO: 11325 - RNA, 21 nt, Artificial Sequence
  Synthetic oligonucleotide
gggcaggugguggccucaaca

SEQ ID NO: 11326 - RNA, 21 nt, Artificial Sequence
  Synthetic oligonucleotide
ggcaggugguggccucaacaa

SEQ ID NO: 11327 - RNA, 21 nt, Artificial Sequence
  Synthetic oligonucleotide
gcaggugguggccucaacaau

SEQ ID NO: 11328 - RNA, 21 nt, Artificial Sequence
  Synthetic oligonucleotide
caggugguggccucaacaaug

SEQ ID NO: 11329 - RNA, 21 nt, Artificial Sequence
  Synthetic oligonucleotide
aggugguggccucaacaaugc

SEQ ID NO: 11330 - RNA, 21 nt, Artificial Sequence
  Synthetic oligonucleotide
ggugguggccucaacaaugcc

SEQ ID NO: 11331 - RNA, 21 nt, Artificial Sequence
  Synthetic oligonucleotide
guguuccaccuagcuggacuu

SEQ ID NO: 11332 - RNA, 21 nt, Artificial Sequence
  Synthetic oligonucleotide
uguuccaccuagcuggacuua

SEQ ID NO: 11333 - RNA, 21 nt, Artificial Sequence
  Synthetic oligonucleotide
guuccaccuagcuggacuuac

SEQ ID NO: 11334 - RNA, 21 nt, Artificial Sequence
  Synthetic oligonucleotide
uuccaccuagcuggacuuacc

SEQ ID NO: 11335 - RNA, 21 nt, Artificial Sequence
  Synthetic oligonucleotide
uccaccuagcuggacuuaccu

SEQ ID NO: 11336 - RNA, 21 nt, Artificial Sequence
  Synthetic oligonucleotide
ccaccuagcuggacuuaccuu

SEQ ID NO: 11337 - RNA, 21 nt, Artificial Sequence
  Synthetic oligonucleotide
caccuagcuggacuuaccuuc

SEQ ID NO: 11338 - RNA, 21 nt, Artificial Sequence
  Synthetic oligonucleotide
accuagcuggacuuaccuucc

SEQ ID NO: 11339 - RNA, 21 nt, Artificial Sequence
  Synthetic oligonucleotide
ccuagcuggacuuaccuuccu

SEQ ID NO: 11340 - RNA, 21 nt, Artificial Sequence
  Synthetic oligonucleotide
cuagcuggacuuaccuuccuc

SEQ ID NO: 11341 - RNA, 21 nt, Artificial Sequence
  Synthetic oligonucleotide
uagcuggacuuaccuuccuca

SEQ ID NO: 11342 - RNA, 21 nt, Artificial Sequence
  Synthetic oligonucleotide
agcuggacuuaccuuccucac

SEQ ID NO: 11343 - RNA, 21 nt, Artificial Sequence
  Synthetic oligonucleotide
gcuggacuuaccuuccucacu

SEQ ID NO: 11344 - RNA, 21 nt, Artificial Sequence
  Synthetic oligonucleotide
cuggacuuaccuuccucacua

SEQ ID NO: 11345 - RNA, 21 nt, Artificial Sequence
  Synthetic oligonucleotide
uggacuuaccuuccucacuaa

SEQ ID NO: 11346 - RNA, 21 nt, Artificial Sequence
  Synthetic oligonucleotide
ggacuuaccuuccucacuaau

SEQ ID NO: 11347 - RNA, 21 nt, Artificial Sequence
  Synthetic oligonucleotide
gacuuaccuuccucacuaaug

SEQ ID NO: 11348 - RNA, 21 nt, Artificial Sequence
  Synthetic oligonucleotide
acuuaccuuccucacuaaugc

SEQ ID NO: 11349 - RNA, 21 nt, Artificial Sequence
  Synthetic oligonucleotide
cuuaccuuccucacuaaugca

SEQ ID NO: 11350 - RNA, 21 nt, Artificial Sequence
  Synthetic oligonucleotide
uuaccuuccucacuaaugcaa

SEQ ID NO: 11351 - RNA, 21 nt, Artificial Sequence
  Synthetic oligonucleotide
uaccuuccucacuaaugcaaa

SEQ ID NO: 11352 - RNA, 21 nt, Artificial Sequence
  Synthetic oligonucleotide
accuuccucacuaaugcaaau

SEQ ID NO: 11353 - RNA, 21 nt, Artificial Sequence
  Synthetic oligonucleotide
ccuuccucacuaaugcaaaug

SEQ ID NO: 11354 - RNA, 21 nt, Artificial Sequence
  Synthetic oligonucleotide
cuuccucacuaaugcaaaugc

SEQ ID NO: 11355 - RNA, 21 nt, Artificial Sequence
  Synthetic oligonucleotide
uuccucacuaaugcaaaugca

SEQ ID NO: 11356 - RNA, 21 nt, Artificial Sequence
  Synthetic oligonucleotide
uccucacuaaugcaaaugcag

SEQ ID NO: 11357 - RNA, 21 nt, Artificial Sequence
  Synthetic oligonucleotide
ccucacuaaugcaaaugcaga

SEQ ID NO: 11358 - RNA, 21 nt, Artificial Sequence
  Synthetic oligonucleotide
cucacuaaugcaaaugcagau

SEQ ID NO: 11359 - RNA, 21 nt, Artificial Sequence
  Synthetic oligonucleotide
ucacuaaugcaaaugcagaug

SEQ ID NO: 11360 - RNA, 21 nt, Artificial Sequence
  Synthetic oligonucleotide
cacuaaugcaaaugcagauga

SEQ ID NO: 11361 - RNA, 21 nt, Artificial Sequence
  Synthetic oligonucleotide
acuaaugcaaaugcagaugac

SEQ ID NO: 11362 - RNA, 21 nt, Artificial Sequence
  Synthetic oligonucleotide
cuaaugcaaaugcagaugacu

SEQ ID NO: 11363 - RNA, 21 nt, Artificial Sequence
  Synthetic oligonucleotide
uaaugcaaaugcagaugacuc

SEQ ID NO: 11364 - RNA, 21 nt, Artificial Sequence
  Synthetic oligonucleotide
aaugcaaaugcagaugacucc

SEQ ID NO: 11365 - RNA, 21 nt, Artificial Sequence
  Synthetic oligonucleotide
augcaaaugcagaugacuccc

SEQ ID NO: 11366 - RNA, 21 nt, Artificial Sequence
  Synthetic oligonucleotide
ugcaaaugcagaugacuccca

SEQ ID NO: 11367 - RNA, 21 nt, Artificial Sequence
  Synthetic oligonucleotide
gcaaaugcagaugacucccaa

SEQ ID NO: 11368 - RNA, 21 nt, Artificial Sequence
  Synthetic oligonucleotide
caaaugcagaugacucccaag

SEQ ID NO: 11369 - RNA, 21 nt, Artificial Sequence
  Synthetic oligonucleotide
aaaugcagaugacucccaaga

SEQ ID NO: 11370 - RNA, 21 nt, Artificial Sequence
  Synthetic oligonucleotide
aaugcagaugacucccaagaa

SEQ ID NO: 11371 - RNA, 21 nt, Artificial Sequence
  Synthetic oligonucleotide
augcagaugacucccaagaaa

SEQ ID NO: 11372 - RNA, 21 nt, Artificial Sequence
  Synthetic oligonucleotide
ugcagaugacucccaagaaaa

SEQ ID NO: 11373 - RNA, 21 nt, Artificial Sequence
  Synthetic oligonucleotide
gcagaugacucccaagaaaau

SEQ ID NO: 11374 - RNA, 21 nt, Artificial Sequence
  Synthetic oligonucleotide
cagaugacucccaagaaaaug

SEQ ID NO: 11375 - RNA, 21 nt, Artificial Sequence
  Synthetic oligonucleotide
agaugacucccaagaaaauga

SEQ ID NO: 11376 - RNA, 21 nt, Artificial Sequence
  Synthetic oligonucleotide
gaugacucccaagaaaaugau

SEQ ID NO: 11377 - RNA, 21 nt, Artificial Sequence
  Synthetic oligonucleotide
augacucccaagaaaaugaug

SEQ ID NO: 11378 - RNA, 21 nt, Artificial Sequence
  Synthetic oligonucleotide
ugacucccaagaaaaugauga

SEQ ID NO: 11379 - RNA, 21 nt, Artificial Sequence
  Synthetic oligonucleotide
gacucccaagaaaaugaugaa

SEQ ID NO: 11380 - RNA, 21 nt, Artificial Sequence
  Synthetic oligonucleotide
acucccaagaaaaugaugaac

SEQ ID NO: 11381 - RNA, 21 nt, Artificial Sequence
  Synthetic oligonucleotide
cucccaagaaaaugaugaacc

SEQ ID NO: 11382 - RNA, 21 nt, Artificial Sequence
  Synthetic oligonucleotide
ucccaagaaaaugaugaaccu

SEQ ID NO: 11383 - RNA, 21 nt, Artificial Sequence
  Synthetic oligonucleotide
cccaagaaaaugaugaaccuu

SEQ ID NO: 11384 - RNA, 21 nt, Artificial Sequence
  Synthetic oligonucleotide
ccaagaaaaugaugaaccuug

SEQ ID NO: 11385 - RNA, 21 nt, Artificial Sequence
  Synthetic oligonucleotide
aagaaaaugaugaaccuugua

SEQ ID NO: 11386 - RNA, 21 nt, Artificial Sequence
  Synthetic oligonucleotide
agaaaaugaugaaccuuguaa

SEQ ID NO: 11387 - RNA, 21 nt, Artificial Sequence
  Synthetic oligonucleotide
gaaaaugaugaaccuuguaaa

SEQ ID NO: 11388 - RNA, 21 nt, Artificial Sequence
  Synthetic oligonucleotide
aaaaugaugaaccuuguaaag

SEQ ID NO: 11389 - RNA, 21 nt, Artificial Sequence
  Synthetic oligonucleotide
aaugaugaaccuuguaaagaa

SEQ ID NO: 11390 - RNA, 21 nt, Artificial Sequence
  Synthetic oligonucleotide
gaugaaccuuguaaagaaauu

SEQ ID NO: 11391 - RNA, 21 nt, Artificial Sequence
  Synthetic oligonucleotide
aaagaagauagaagaaauagc

SEQ ID NO: 11392 - RNA, 21 nt, Artificial Sequence
  Synthetic oligonucleotide
aagaagauagaagaaauagcu

SEQ ID NO: 11393 - RNA, 21 nt, Artificial Sequence
  Synthetic oligonucleotide
agaagauagaagaaauagcug

SEQ ID NO: 11394 - RNA, 21 nt, Artificial Sequence
  Synthetic oligonucleotide
gaagauagaagaaauagcugc

SEQ ID NO: 11395 - RNA, 21 nt, Artificial Sequence
  Synthetic oligonucleotide
aagauagaagaaauagcugcu

SEQ ID NO: 11396 - RNA, 21 nt, Artificial Sequence
  Synthetic oligonucleotide
agauagaagaaauagcugcua

SEQ ID NO: 11397 - RNA, 21 nt, Artificial Sequence
  Synthetic oligonucleotide
gauagaagaaauagcugcuaa

SEQ ID NO: 11398 - RNA, 21 nt, Artificial Sequence
  Synthetic oligonucleotide
auagaagaaauagcugcuaaa

SEQ ID NO: 11399 - RNA, 21 nt, Artificial Sequence
  Synthetic oligonucleotide
uagaagaaauagcugcuaaau

SEQ ID NO: 11400 - RNA, 21 nt, Artificial Sequence
  Synthetic oligonucleotide
agaagaaauagcugcuaaaua

SEQ ID NO: 11401 - RNA, 21 nt, Artificial Sequence
  Synthetic oligonucleotide
gaagaaauagcugcuaaauau

SEQ ID NO: 11402 - RNA, 21 nt, Artificial Sequence
  Synthetic oligonucleotide
aagaaauagcugcuaaauaua

SEQ ID NO: 11403 - RNA, 21 nt, Artificial Sequence
  Synthetic oligonucleotide
agaaauagcugcuaaauauaa

SEQ ID NO: 11404 - RNA, 21 nt, Artificial Sequence
  Synthetic oligonucleotide
gaaauagcugcuaaauauaaa

SEQ ID NO: 11405 - RNA, 21 nt, Artificial Sequence
  Synthetic oligonucleotide
aaauagcugcuaaauauaaac

SEQ ID NO: 11406 - RNA, 21 nt, Artificial Sequence
  Synthetic oligonucleotide
aauagcugcuaaauauaaaca

SEQ ID NO: 11407 - RNA, 21 nt, Artificial Sequence
  Synthetic oligonucleotide
auagcugcuaaauauaaacau

SEQ ID NO: 11408 - RNA, 21 nt, Artificial Sequence
  Synthetic oligonucleotide
uagcugcuaaauauaaacauu

SEQ ID NO: 11409 - RNA, 21 nt, Artificial Sequence
  Synthetic oligonucleotide
aguagugaagaaauguuguua

SEQ ID NO: 11410 - RNA, 21 nt, Artificial Sequence
  Synthetic oligonucleotide
guagugaagaaauguuguuac

SEQ ID NO: 11411 - RNA, 21 nt, Artificial Sequence
  Synthetic oligonucleotide
uagugaagaaauguuguuacg

SEQ ID NO: 11412 - RNA, 21 nt, Artificial Sequence
  Synthetic oligonucleotide
agugaagaaauguuguuacga

SEQ ID NO: 11413 - RNA, 21 nt, Artificial Sequence
  Synthetic oligonucleotide
gugaagaaauguuguuacgau

SEQ ID NO: 11414 - RNA, 21 nt, Artificial Sequence
  Synthetic oligonucleotide
ugaagaaauguuguuacgaug

SEQ ID NO: 11415 - RNA, 21 nt, Artificial Sequence
  Synthetic oligonucleotide
gaagaaauguuguuacgaugg

SEQ ID NO: 11416 - RNA, 21 nt, Artificial Sequence
  Synthetic oligonucleotide
aagaaauguuguuacgaugga

SEQ ID NO: 11417 - RNA, 21 nt, Artificial Sequence
  Synthetic oligonucleotide
agaaauguuguuacgauggag

SEQ ID NO: 11418 - RNA, 21 nt, Artificial Sequence
  Synthetic oligonucleotide
uaaugaugaaaccugugagca

SEQ ID NO: 11419 - RNA, 21 nt, Artificial Sequence
  Synthetic oligonucleotide
aaugaugaaaccugugagcag

SEQ ID NO: 11420 - RNA, 21 nt, Artificial Sequence
  Synthetic oligonucleotide
augaugaaaccugugagcagc

SEQ ID NO: 11421 - RNA, 21 nt, Artificial Sequence
  Synthetic oligonucleotide
ugaugaaaccugugagcagcg

SEQ ID NO: 11422 - RNA, 21 nt, Artificial Sequence
  Synthetic oligonucleotide
gaugaaaccugugagcagcga

SEQ ID NO: 11423 - RNA, 21 nt, Artificial Sequence
  Synthetic oligonucleotide
augaaaccugugagcagcgag

SEQ ID NO: 11424 - RNA, 21 nt, Artificial Sequence
  Synthetic oligonucleotide
ugaaaccugugagcagcgagc

SEQ ID NO: 11425 - RNA, 21 nt, Artificial Sequence
  Synthetic oligonucleotide
aaccugugagcagcgagcugc

SEQ ID NO: 11426 - RNA, 21 nt, Artificial Sequence
  Synthetic oligonucleotide
accugugagcagcgagcugca

SEQ ID NO: 11427 - RNA, 21 nt, Artificial Sequence
  Synthetic oligonucleotide
ccugugagcagcgagcugcac

SEQ ID NO: 11428 - RNA, 21 nt, Artificial Sequence
  Synthetic oligonucleotide
cugugagcagcgagcugcacg

SEQ ID NO: 11429 - RNA, 21 nt, Artificial Sequence
  Synthetic oligonucleotide
ugugagcagcgagcugcacgg

SEQ ID NO: 11430 - RNA, 21 nt, Artificial Sequence
  Synthetic oligonucleotide
gugagcagcgagcugcacgga

SEQ ID NO: 11431 - RNA, 21 nt, Artificial Sequence
  Synthetic oligonucleotide
ugagcagcgagcugcacggau

SEQ ID NO: 11432 - RNA, 21 nt, Artificial Sequence
  Synthetic oligonucleotide
gagcagcgagcugcacggauu

SEQ ID NO: 11433 - RNA, 21 nt, Artificial Sequence
  Synthetic oligonucleotide
agcagcgagcugcacggauua

SEQ ID NO: 11434 - RNA, 21 nt, Artificial Sequence
  Synthetic oligonucleotide
gcagcgagcugcacggauuag

SEQ ID NO: 11435 - RNA, 21 nt, Artificial Sequence
  Synthetic oligonucleotide
cagcgagcugcacggauuagu

SEQ ID NO: 11436 - RNA, 21 nt, Artificial Sequence
  Synthetic oligonucleotide
gugucgucgcaagccagcucc

SEQ ID NO: 11437 - RNA, 21 nt, Artificial Sequence
  Synthetic oligonucleotide
ugucgucgcaagccagcuccg

SEQ ID NO: 11438 - RNA, 21 nt, Artificial Sequence
  Synthetic oligonucleotide
gucgucgcaagccagcuccgu

SEQ ID NO: 11439 - RNA, 21 nt, Artificial Sequence
  Synthetic oligonucleotide
ucgucgcaagccagcuccgug

SEQ ID NO: 11440 - RNA, 21 nt, Artificial Sequence
  Synthetic oligonucleotide
cgucgcaagccagcuccgugc

SEQ ID NO: 11441 - RNA, 21 nt, Artificial Sequence
  Synthetic oligonucleotide
gucgcaagccagcuccgugcu

SEQ ID NO: 11442 - RNA, 21 nt, Artificial Sequence
  Synthetic oligonucleotide
ucgcaagccagcuccgugcua

SEQ ID NO: 11443 - RNA, 21 nt, Artificial Sequence
  Synthetic oligonucleotide
cgcaagccagcuccgugcuaa

SEQ ID NO: 11444 - RNA, 21 nt, Artificial Sequence
  Synthetic oligonucleotide
gcaagccagcuccgugcuaau

SEQ ID NO: 11445 - RNA, 21 nt, Artificial Sequence
  Synthetic oligonucleotide
caagccagcuccgugcuaaua

SEQ ID NO: 11446 - RNA, 21 nt, Artificial Sequence
  Synthetic oligonucleotide
cacaugaagacccuguuacca

SEQ ID NO: 11447 - RNA, 21 nt, Artificial Sequence
  Synthetic oligonucleotide
acaugaagacccuguuaccag

SEQ ID NO: 11448 - RNA, 21 nt, Artificial Sequence
  Synthetic oligonucleotide
caugaagacccuguuaccagu

SEQ ID NO: 11449 - RNA, 21 nt, Artificial Sequence
  Synthetic oligonucleotide
ugaagacccuguuaccaguaa

SEQ ID NO: 11450 - RNA, 21 nt, Artificial Sequence
  Synthetic oligonucleotide
gaagacccuguuaccaguaag

SEQ ID NO: 11451 - RNA, 21 nt, Artificial Sequence
  Synthetic oligonucleotide
aagacccuguuaccaguaagc

SEQ ID NO: 11452 - RNA, 21 nt, Artificial Sequence
  Synthetic oligonucleotide
agacccuguuaccaguaagca

SEQ ID NO: 11453 - RNA, 21 nt, Artificial Sequence
  Synthetic oligonucleotide
gacccuguuaccaguaagcaa

SEQ ID NO: 11454 - RNA, 21 nt, Artificial Sequence
  Synthetic oligonucleotide
acccuguuaccaguaagcaag

SEQ ID NO: 11455 - RNA, 21 nt, Artificial Sequence
  Synthetic oligonucleotide
cccuguuaccaguaagcaagc

SEQ ID NO: 11456 - RNA, 21 nt, Artificial Sequence
  Synthetic oligonucleotide
ccuguuaccaguaagcaagcc

SEQ ID NO: 11457 - RNA, 21 nt, Artificial Sequence
  Synthetic oligonucleotide
cuguuaccaguaagcaagcca

SEQ ID NO: 11458 - RNA, 21 nt, Artificial Sequence
  Synthetic oligonucleotide
uguuaccaguaagcaagccag

SEQ ID NO: 11459 - RNA, 21 nt, Artificial Sequence
  Synthetic oligonucleotide
guuaccaguaagcaagccaga

SEQ ID NO: 11460 - RNA, 21 nt, Artificial Sequence
  Synthetic oligonucleotide
uuaccaguaagcaagccagaa

SEQ ID NO: 11461 - RNA, 21 nt, Artificial Sequence
  Synthetic oligonucleotide
uaccaguaagcaagccagaaa

SEQ ID NO: 11462 - RNA, 21 nt, Artificial Sequence
  Synthetic oligonucleotide
accaguaagcaagccagaaau

SEQ ID NO: 11463 - RNA, 21 nt, Artificial Sequence
  Synthetic oligonucleotide
ccaguaagcaagccagaaauu

SEQ ID NO: 11464 - RNA, 21 nt, Artificial Sequence
  Synthetic oligonucleotide
caguaagcaagccagaaauuc

SEQ ID NO: 11465 - RNA, 21 nt, Artificial Sequence
  Synthetic oligonucleotide
aguaagcaagccagaaauucg

SEQ ID NO: 11466 - RNA, 21 nt, Artificial Sequence
  Synthetic oligonucleotide
guaagcaagccagaaauucgg

SEQ ID NO: 11467 - RNA, 21 nt, Artificial Sequence
  Synthetic oligonucleotide
uaagcaagccagaaauucgga

SEQ ID NO: 11468 - RNA, 21 nt, Artificial Sequence
  Synthetic oligonucleotide
aagcaagccagaaauucggag

SEQ ID NO: 11469 - RNA, 21 nt, Artificial Sequence
  Synthetic oligonucleotide
gcaagccagaaauucggaguu

SEQ ID NO: 11470 - RNA, 21 nt, Artificial Sequence
  Synthetic oligonucleotide
caagccagaaauucggaguua

SEQ ID NO: 11471 - RNA, 21 nt, Artificial Sequence
  Synthetic oligonucleotide
aagccagaaauucggaguuau

SEQ ID NO: 11472 - RNA, 21 nt, Artificial Sequence
  Synthetic oligonucleotide
agccagaaauucggaguuauu

SEQ ID NO: 11473 - RNA, 21 nt, Artificial Sequence
  Synthetic oligonucleotide
gccagaaauucggaguuauuu

SEQ ID NO: 11474 - RNA, 21 nt, Artificial Sequence
  Synthetic oligonucleotide
ccagaaauucggaguuauuuu

SEQ ID NO: 11475 - RNA, 21 nt, Artificial Sequence
  Synthetic oligonucleotide
cagaaauucggaguuauuuuc

SEQ ID NO: 11476 - RNA, 21 nt, Artificial Sequence
  Synthetic oligonucleotide
agaaauucggaguuauuuucc

SEQ ID NO: 11477 - RNA, 21 nt, Artificial Sequence
  Synthetic oligonucleotide
gaaauucggaguuauuuucca

SEQ ID NO: 11478 - RNA, 21 nt, Artificial Sequence
  Synthetic oligonucleotide
aaauucggaguuauuuuccag

SEQ ID NO: 11479 - RNA, 21 nt, Artificial Sequence
  Synthetic oligonucleotide
aauucggaguuauuuuccaga

SEQ ID NO: 11480 - RNA, 21 nt, Artificial Sequence
  Synthetic oligonucleotide
auucggaguuauuuuccagaa

SEQ ID NO: 11481 - RNA, 21 nt, Artificial Sequence
  Synthetic oligonucleotide
uucggaguuauuuuccagaaa

SEQ ID NO: 11482 - RNA, 21 nt, Artificial Sequence
  Synthetic oligonucleotide
ucggaguuauuuuccagaaag

SEQ ID NO: 11483 - RNA, 21 nt, Artificial Sequence
  Synthetic oligonucleotide
cggaguuauuuuccagaaagc

SEQ ID NO: 11484 - RNA, 21 nt, Artificial Sequence
  Synthetic oligonucleotide
ggaguuauuuuccagaaagcu

SEQ ID NO: 11485 - RNA, 21 nt, Artificial Sequence
  Synthetic oligonucleotide
gaguuauuuuccagaaagcug

SEQ ID NO: 11486 - RNA, 21 nt, Artificial Sequence
  Synthetic oligonucleotide
aguuauuuuccagaaagcugg

SEQ ID NO: 11487 - RNA, 21 nt, Artificial Sequence
  Synthetic oligonucleotide
guuauuuuccagaaagcuggu

SEQ ID NO: 11488 - RNA, 21 nt, Artificial Sequence
  Synthetic oligonucleotide
uuauuuuccagaaagcugguu

SEQ ID NO: 11489 - RNA, 21 nt, Artificial Sequence
  Synthetic oligonucleotide
ugugggaaguucaucuuguuc

SEQ ID NO: 11490 - RNA, 21 nt, Artificial Sequence
  Synthetic oligonucleotide
gugggaaguucaucuuguucc

SEQ ID NO: 11491 - RNA, 21 nt, Artificial Sequence
  Synthetic oligonucleotide
ugggaaguucaucuuguuccc

SEQ ID NO: 11492 - RNA, 21 nt, Artificial Sequence
  Synthetic oligonucleotide
gggaaguucaucuuguuccca

SEQ ID NO: 11493 - RNA, 21 nt, Artificial Sequence
  Synthetic oligonucleotide
ggaaguucaucuuguucccag

SEQ ID NO: 11494 - RNA, 21 nt, Artificial Sequence
  Synthetic oligonucleotide
gaaguucaucuuguucccaga

SEQ ID NO: 11495 - RNA, 21 nt, Artificial Sequence
  Synthetic oligonucleotide
aaguucaucuuguucccagaa

SEQ ID NO: 11496 - RNA, 21 nt, Artificial Sequence
  Synthetic oligonucleotide
aguucaucuuguucccagaag

SEQ ID NO: 11497 - RNA, 21 nt, Artificial Sequence
  Synthetic oligonucleotide
guucaucuuguucccagaaga

SEQ ID NO: 11498 - RNA, 21 nt, Artificial Sequence
  Synthetic oligonucleotide
uucaucuuguucccagaagaa

SEQ ID NO: 11499 - RNA, 21 nt, Artificial Sequence
  Synthetic oligonucleotide
ucaucuuguucccagaagaaa

SEQ ID NO: 11500 - RNA, 21 nt, Artificial Sequence
  Synthetic oligonucleotide
caucuuguucccagaagaaaa

SEQ ID NO: 11501 - RNA, 21 nt, Artificial Sequence
  Synthetic oligonucleotide
aucuuguucccagaagaaaac

SEQ ID NO: 11502 - RNA, 21 nt, Artificial Sequence
  Synthetic oligonucleotide
ucuuguucccagaagaaaaca

SEQ ID NO: 11503 - RNA, 21 nt, Artificial Sequence
  Synthetic oligonucleotide
cuuguucccagaagaaaacag

SEQ ID NO: 11504 - RNA, 21 nt, Artificial Sequence
  Synthetic oligonucleotide
uuguucccagaagaaaacagu

SEQ ID NO: 11505 - RNA, 21 nt, Artificial Sequence
  Synthetic oligonucleotide
uguucccagaagaaaacaguu

SEQ ID NO: 11506 - RNA, 21 nt, Artificial Sequence
  Synthetic oligonucleotide
guucccagaagaaaacaguug

SEQ ID NO: 11507 - RNA, 21 nt, Artificial Sequence
  Synthetic oligonucleotide
uucccagaagaaaacaguugc

SEQ ID NO: 11508 - RNA, 21 nt, Artificial Sequence
  Synthetic oligonucleotide
ucccagaagaaaacaguugca

SEQ ID NO: 11509 - RNA, 21 nt, Artificial Sequence
  Synthetic oligonucleotide
cccagaagaaaacaguugcag

SEQ ID NO: 11510 - RNA, 21 nt, Artificial Sequence
  Synthetic oligonucleotide
ccagaagaaaacaguugcagu

SEQ ID NO: 11511 - RNA, 21 nt, Artificial Sequence
  Synthetic oligonucleotide
cagaagaaaacaguugcaguu

SEQ ID NO: 11512 - RNA, 21 nt, Artificial Sequence
  Synthetic oligonucleotide
agaagaaaacaguugcaguuu

SEQ ID NO: 11513 - RNA, 21 nt, Artificial Sequence
  Synthetic oligonucleotide
gaagaaaacaguugcaguuug

SEQ ID NO: 11514 - RNA, 21 nt, Artificial Sequence
  Synthetic oligonucleotide
aagaaaacaguugcaguuugc

SEQ ID NO: 11515 - RNA, 21 nt, Artificial Sequence
  Synthetic oligonucleotide
agaaaacaguugcaguuugcc

SEQ ID NO: 11516 - RNA, 21 nt, Artificial Sequence
  Synthetic oligonucleotide
gaaaacaguugcaguuugccc

SEQ ID NO: 11517 - RNA, 21 nt, Artificial Sequence
  Synthetic oligonucleotide
aaaacaguugcaguuugcccu

SEQ ID NO: 11518 - RNA, 21 nt, Artificial Sequence
  Synthetic oligonucleotide
aaacaguugcaguuugcccua

SEQ ID NO: 11519 - RNA, 21 nt, Artificial Sequence
  Synthetic oligonucleotide
aacaguugcaguuugcccuac

SEQ ID NO: 11520 - RNA, 21 nt, Artificial Sequence
  Synthetic oligonucleotide
acaguugcaguuugcccuacc

SEQ ID NO: 11521 - RNA, 21 nt, Artificial Sequence
  Synthetic oligonucleotide
caguugcaguuugcccuaccu

SEQ ID NO: 11522 - RNA, 21 nt, Artificial Sequence
  Synthetic oligonucleotide
aguugcaguuugcccuaccug

SEQ ID NO: 11523 - RNA, 21 nt, Artificial Sequence
  Synthetic oligonucleotide
guugcaguuugcccuaccuga

SEQ ID NO: 11524 - RNA, 21 nt, Artificial Sequence
  Synthetic oligonucleotide
uugcaguuugcccuaccugau

SEQ ID NO: 11525 - RNA, 21 nt, Artificial Sequence
  Synthetic oligonucleotide
ugcaguuugcccuaccugauu

SEQ ID NO: 11526 - RNA, 21 nt, Artificial Sequence
  Synthetic oligonucleotide
gcaguuugcccuaccugauuc

SEQ ID NO: 11527 - RNA, 21 nt, Artificial Sequence
  Synthetic oligonucleotide
caguuugcccuaccugauucu

SEQ ID NO: 11528 - RNA, 21 nt, Artificial Sequence
  Synthetic oligonucleotide
aaggcaaagguguucaaagau

SEQ ID NO: 11529 - RNA, 21 nt, Artificial Sequence
  Synthetic oligonucleotide
aggcaaagguguucaaagaug

SEQ ID NO: 11530 - RNA, 21 nt, Artificial Sequence
  Synthetic oligonucleotide
ggcaaagguguucaaagaugu

SEQ ID NO: 11531 - RNA, 21 nt, Artificial Sequence
  Synthetic oligonucleotide
gcaaagguguucaaagauguc

SEQ ID NO: 11532 - RNA, 21 nt, Artificial Sequence
  Synthetic oligonucleotide
caaagguguucaaagaugucu

SEQ ID NO: 11533 - RNA, 21 nt, Artificial Sequence
  Synthetic oligonucleotide
aaagguguucaaagaugucuu

SEQ ID NO: 11534 - RNA, 21 nt, Artificial Sequence
  Synthetic oligonucleotide
aagguguucaaagaugucuuc

SEQ ID NO: 11535 - RNA, 21 nt, Artificial Sequence
  Synthetic oligonucleotide
agguguucaaagaugucuucc

SEQ ID NO: 11536 - RNA, 21 nt, Artificial Sequence
  Synthetic oligonucleotide
gguguucaaagaugucuuccu

SEQ ID NO: 11537 - RNA, 21 nt, Artificial Sequence
  Synthetic oligonucleotide
guguucaaagaugucuuccug

SEQ ID NO: 11538 - RNA, 21 nt, Artificial Sequence
  Synthetic oligonucleotide
uguucaaagaugucuuccugg

SEQ ID NO: 11539 - RNA, 21 nt, Artificial Sequence
  Synthetic oligonucleotide
guucaaagaugucuuccugga

SEQ ID NO: 11540 - RNA, 21 nt, Artificial Sequence
  Synthetic oligonucleotide
uucaaagaugucuuccuggaa

SEQ ID NO: 11541 - RNA, 21 nt, Artificial Sequence
  Synthetic oligonucleotide
ucaaagaugucuuccuggaaa

SEQ ID NO: 11542 - RNA, 21 nt, Artificial Sequence
  Synthetic oligonucleotide
caaagaugucuuccuggaaau

SEQ ID NO: 11543 - RNA, 21 nt, Artificial Sequence
  Synthetic oligonucleotide
aaagaugucuuccuggaaaug

SEQ ID NO: 11544 - RNA, 21 nt, Artificial Sequence
  Synthetic oligonucleotide
agaugucuuccuggaaaugaa

SEQ ID NO: 11545 - RNA, 21 nt, Artificial Sequence
  Synthetic oligonucleotide
gaugucuuccuggaaaugaau

SEQ ID NO: 11546 - RNA, 21 nt, Artificial Sequence
  Synthetic oligonucleotide
augucuuccuggaaaugaaua

SEQ ID NO: 11547 - RNA, 21 nt, Artificial Sequence
  Synthetic oligonucleotide
ugucuuccuggaaaugaauau

SEQ ID NO: 11548 - RNA, 21 nt, Artificial Sequence
  Synthetic oligonucleotide
gucuuccuggaaaugaauaua

SEQ ID NO: 11549 - RNA, 21 nt, Artificial Sequence
  Synthetic oligonucleotide
ucuuccuggaaaugaauauac

SEQ ID NO: 11550 - RNA, 21 nt, Artificial Sequence
  Synthetic oligonucleotide
cuuccuggaaaugaauauacc

SEQ ID NO: 11551 - RNA, 21 nt, Artificial Sequence
  Synthetic oligonucleotide
uuccuggaaaugaauauacca

SEQ ID NO: 11552 - RNA, 21 nt, Artificial Sequence
  Synthetic oligonucleotide
aauauaccauauucuguugua

SEQ ID NO: 11553 - RNA, 21 nt, Artificial Sequence
  Synthetic oligonucleotide
auauaccauauucuguuguac

SEQ ID NO: 11554 - RNA, 21 nt, Artificial Sequence
  Synthetic oligonucleotide
uauaccauauucuguuguacg

SEQ ID NO: 11555 - RNA, 21 nt, Artificial Sequence
  Synthetic oligonucleotide
auaccauauucuguuguacga

SEQ ID NO: 11556 - RNA, 21 nt, Artificial Sequence
  Synthetic oligonucleotide
uaccauauucuguuguacgag

SEQ ID NO: 11557 - RNA, 21 nt, Artificial Sequence
  Synthetic oligonucleotide
accauauucuguuguacgagg

SEQ ID NO: 11558 - RNA, 21 nt, Artificial Sequence
  Synthetic oligonucleotide
ccauauucuguuguacgagga

SEQ ID NO: 11559 - RNA, 21 nt, Artificial Sequence
  Synthetic oligonucleotide
cauauucuguuguacgaggag

SEQ ID NO: 11560 - RNA, 21 nt, Artificial Sequence
  Synthetic oligonucleotide
auauucuguuguacgaggaga

SEQ ID NO: 11561 - RNA, 21 nt, Artificial Sequence
  Synthetic oligonucleotide
uauucuguuguacgaggagaa

SEQ ID NO: 11562 - RNA, 21 nt, Artificial Sequence
  Synthetic oligonucleotide
auucuguuguacgaggagaac

SEQ ID NO: 11563 - RNA, 21 nt, Artificial Sequence
  Synthetic oligonucleotide
uucuguuguacgaggagaaca

SEQ ID NO: 11564 - RNA, 21 nt, Artificial Sequence
  Synthetic oligonucleotide
ucuguuguacgaggagaacag

SEQ ID NO: 11565 - RNA, 21 nt, Artificial Sequence
  Synthetic oligonucleotide
aggaacuguuuacaacuauag

SEQ ID NO: 11566 - RNA, 21 nt, Artificial Sequence
  Synthetic oligonucleotide
ggaacuguuuacaacuauagg

SEQ ID NO: 11567 - RNA, 21 nt, Artificial Sequence
  Synthetic oligonucleotide
gaacuguuuacaacuauagga

SEQ ID NO: 11568 - RNA, 21 nt, Artificial Sequence
  Synthetic oligonucleotide
aacuguuuacaacuauaggac

SEQ ID NO: 11569 - RNA, 21 nt, Artificial Sequence
  Synthetic oligonucleotide
acuguuuacaacuauaggacu

SEQ ID NO: 11570 - RNA, 21 nt, Artificial Sequence
  Synthetic oligonucleotide
cuguuuacaacuauaggacuu

SEQ ID NO: 11571 - RNA, 21 nt, Artificial Sequence
  Synthetic oligonucleotide
uguuuacaacuauaggacuuc

SEQ ID NO: 11572 - RNA, 21 nt, Artificial Sequence
  Synthetic oligonucleotide
guuuacaacuauaggacuucu

SEQ ID NO: 11573 - RNA, 21 nt, Artificial Sequence
  Synthetic oligonucleotide
uuuacaacuauaggacuucug

SEQ ID NO: 11574 - RNA, 21 nt, Artificial Sequence
  Synthetic oligonucleotide
uuacaacuauaggacuucugg

SEQ ID NO: 11575 - RNA, 21 nt, Artificial Sequence
  Synthetic oligonucleotide
uacaacuauaggacuucuggg

SEQ ID NO: 11576 - RNA, 21 nt, Artificial Sequence
  Synthetic oligonucleotide
acaacuauaggacuucuggga

SEQ ID NO: 11577 - RNA, 21 nt, Artificial Sequence
  Synthetic oligonucleotide
caacuauaggacuucugggau

SEQ ID NO: 11578 - RNA, 21 nt, Artificial Sequence
  Synthetic oligonucleotide
aacuauaggacuucugggaug

SEQ ID NO: 11579 - RNA, 21 nt, Artificial Sequence
  Synthetic oligonucleotide
acuauaggacuucugggaugc

SEQ ID NO: 11580 - RNA, 21 nt, Artificial Sequence
  Synthetic oligonucleotide
cuauaggacuucugggaugca

SEQ ID NO: 11581 - RNA, 21 nt, Artificial Sequence
  Synthetic oligonucleotide
uauaggacuucugggaugcag

SEQ ID NO: 11582 - RNA, 21 nt, Artificial Sequence
  Synthetic oligonucleotide
auaggacuucugggaugcagu

SEQ ID NO: 11583 - RNA, 21 nt, Artificial Sequence
  Synthetic oligonucleotide
aaaaugucugcuguggaggga

SEQ ID NO: 11584 - RNA, 21 nt, Artificial Sequence
  Synthetic oligonucleotide
aaaugucugcuguggagggaa

SEQ ID NO: 11585 - RNA, 21 nt, Artificial Sequence
  Synthetic oligonucleotide
aaugucugcuguggagggaau

SEQ ID NO: 11586 - RNA, 21 nt, Artificial Sequence
  Synthetic oligonucleotide
augucugcuguggagggaauc

SEQ ID NO: 11587 - RNA, 21 nt, Artificial Sequence
  Synthetic oligonucleotide
ugucugcuguggagggaaucu

SEQ ID NO: 11588 - RNA, 21 nt, Artificial Sequence
  Synthetic oligonucleotide
gucugcuguggagggaaucug

SEQ ID NO: 11589 - RNA, 21 nt, Artificial Sequence
  Synthetic oligonucleotide
ucugcuguggagggaaucugc

SEQ ID NO: 11590 - RNA, 21 nt, Artificial Sequence
  Synthetic oligonucleotide
cugcuguggagggaaucugca

SEQ ID NO: 11591 - RNA, 21 nt, Artificial Sequence
  Synthetic oligonucleotide
ugcuguggagggaaucugcac

SEQ ID NO: 11592 - RNA, 21 nt, Artificial Sequence
  Synthetic oligonucleotide
gcuguggagggaaucugcacu

SEQ ID NO: 11593 - RNA, 21 nt, Artificial Sequence
  Synthetic oligonucleotide
cuguggagggaaucugcacuu

SEQ ID NO: 11594 - RNA, 21 nt, Artificial Sequence
  Synthetic oligonucleotide
uguggagggaaucugcacuuc

SEQ ID NO: 11595 - RNA, 21 nt, Artificial Sequence
  Synthetic oligonucleotide
cggaaagcccagucauugauc

SEQ ID NO: 11596 - RNA, 21 nt, Artificial Sequence
  Synthetic oligonucleotide
ggaaagcccagucauugauca

SEQ ID NO: 11597 - RNA, 21 nt, Artificial Sequence
  Synthetic oligonucleotide
gaaagcccagucauugaucau

SEQ ID NO: 11598 - RNA, 21 nt, Artificial Sequence
  Synthetic oligonucleotide
aaagcccagucauugaucauc

SEQ ID NO: 11599 - RNA, 21 nt, Artificial Sequence
  Synthetic oligonucleotide
aagcccagucauugaucauca

SEQ ID NO: 11600 - RNA, 21 nt, Artificial Sequence
  Synthetic oligonucleotide
agcccagucauugaucaucag

SEQ ID NO: 11601 - RNA, 21 nt, Artificial Sequence
  Synthetic oligonucleotide
gcccagucauugaucaucagg

SEQ ID NO: 11602 - RNA, 21 nt, Artificial Sequence
  Synthetic oligonucleotide
cccagucauugaucaucaggg

SEQ ID NO: 11603 - RNA, 21 nt, Artificial Sequence
  Synthetic oligonucleotide
ccagucauugaucaucagggc

SEQ ID NO: 11604 - RNA, 21 nt, Artificial Sequence
  Synthetic oligonucleotide
cagucauugaucaucagggca

SEQ ID NO: 11605 - RNA, 21 nt, Artificial Sequence
  Synthetic oligonucleotide
agucauugaucaucagggcac

SEQ ID NO: 11606 - RNA, 21 nt, Artificial Sequence
  Synthetic oligonucleotide
gucauugaucaucagggcaca

SEQ ID NO: 11607 - RNA, 21 nt, Artificial Sequence
  Synthetic oligonucleotide
ucauugaucaucagggcacaa

SEQ ID NO: 11608 - RNA, 21 nt, Artificial Sequence
  Synthetic oligonucleotide
cauugaucaucagggcacaaa

SEQ ID NO: 11609 - RNA, 21 nt, Artificial Sequence
  Synthetic oligonucleotide
auugaucaucagggcacaaag

SEQ ID NO: 11610 - RNA, 21 nt, Artificial Sequence
  Synthetic oligonucleotide
uugaucaucagggcacaaagu

SEQ ID NO: 11611 - RNA, 21 nt, Artificial Sequence
  Synthetic oligonucleotide
ugaucaucagggcacaaaguc

SEQ ID NO: 11612 - RNA, 21 nt, Artificial Sequence
  Synthetic oligonucleotide
gaucaucagggcacaaagucc

SEQ ID NO: 11613 - RNA, 21 nt, Artificial Sequence
  Synthetic oligonucleotide
aucaucagggcacaaaguccu

SEQ ID NO: 11614 - RNA, 21 nt, Artificial Sequence
  Synthetic oligonucleotide
ucaucagggcacaaaguccuc

SEQ ID NO: 11615 - RNA, 21 nt, Artificial Sequence
  Synthetic oligonucleotide
caucagggcacaaaguccucc

SEQ ID NO: 11616 - RNA, 21 nt, Artificial Sequence
  Synthetic oligonucleotide
aucagggcacaaaguccucca

SEQ ID NO: 11617 - RNA, 21 nt, Artificial Sequence
  Synthetic oligonucleotide
ccagaaaguagagggcuccuc

SEQ ID NO: 11618 - RNA, 21 nt, Artificial Sequence
  Synthetic oligonucleotide
ucacugugcuuccucuggaaa

SEQ ID NO: 11619 - RNA, 21 nt, Artificial Sequence
  Synthetic oligonucleotide
cacugugcuuccucuggaaau

SEQ ID NO: 11620 - RNA, 21 nt, Artificial Sequence
  Synthetic oligonucleotide
acugugcuuccucuggaaauu

SEQ ID NO: 11621 - RNA, 21 nt, Artificial Sequence
  Synthetic oligonucleotide
cugugcuuccucuggaaauug

SEQ ID NO: 11622 - RNA, 21 nt, Artificial Sequence
  Synthetic oligonucleotide
ugguuuggaaaagaaaucuua

SEQ ID NO: 11623 - RNA, 21 nt, Artificial Sequence
  Synthetic oligonucleotide
gguuuggaaaagaaaucuuag

SEQ ID NO: 11624 - RNA, 21 nt, Artificial Sequence
  Synthetic oligonucleotide
guuuggaaaagaaaucuuagu

SEQ ID NO: 11625 - RNA, 21 nt, Artificial Sequence
  Synthetic oligonucleotide
uuuggaaaagaaaucuuagua

SEQ ID NO: 11626 - RNA, 21 nt, Artificial Sequence
  Synthetic oligonucleotide
uuggaaaagaaaucuuaguaa

SEQ ID NO: 11627 - RNA, 21 nt, Artificial Sequence
  Synthetic oligonucleotide
uggaaaagaaaucuuaguaaa

SEQ ID NO: 11628 - RNA, 21 nt, Artificial Sequence
  Synthetic oligonucleotide
ggaaaagaaaucuuaguaaaa

SEQ ID NO: 11629 - RNA, 21 nt, Artificial Sequence
  Synthetic oligonucleotide
cauuacgaguggugccagaag

SEQ ID NO: 11630 - RNA, 21 nt, Artificial Sequence
  Synthetic oligonucleotide
auuacgaguggugccagaagg

SEQ ID NO: 11631 - RNA, 21 nt, Artificial Sequence
  Synthetic oligonucleotide
uuacgaguggugccagaaggu

SEQ ID NO: 11632 - RNA, 21 nt, Artificial Sequence
  Synthetic oligonucleotide
uacgaguggugccagaaggug

SEQ ID NO: 11633 - RNA, 21 nt, Artificial Sequence
  Synthetic oligonucleotide
acgaguggugccagaaggugu

SEQ ID NO: 11634 - RNA, 21 nt, Artificial Sequence
  Synthetic oligonucleotide
cgaguggugccagaagguguc

SEQ ID NO: 11635 - RNA, 21 nt, Artificial Sequence
  Synthetic oligonucleotide
gaguggugccagaagguguca

SEQ ID NO: 11636 - RNA, 21 nt, Artificial Sequence
  Synthetic oligonucleotide
aguggugccagaaggugucaa

SEQ ID NO: 11637 - RNA, 21 nt, Artificial Sequence
  Synthetic oligonucleotide
guggugccagaaggugucaaa

SEQ ID NO: 11638 - RNA, 21 nt, Artificial Sequence
  Synthetic oligonucleotide
uggugccagaaggugucaaaa

SEQ ID NO: 11639 - RNA, 21 nt, Artificial Sequence
  Synthetic oligonucleotide
ggugccagaaggugucaaaag

SEQ ID NO: 11640 - RNA, 21 nt, Artificial Sequence
  Synthetic oligonucleotide
gugccagaaggugucaaaagg

SEQ ID NO: 11641 - RNA, 21 nt, Artificial Sequence
  Synthetic oligonucleotide
ugccagaaggugucaaaaggg

SEQ ID NO: 11642 - RNA, 21 nt, Artificial Sequence
  Synthetic oligonucleotide
gccagaaggugucaaaaggga

SEQ ID NO: 11643 - RNA, 21 nt, Artificial Sequence
  Synthetic oligonucleotide
ccagaaggugucaaaagggaa

SEQ ID NO: 11644 - RNA, 21 nt, Artificial Sequence
  Synthetic oligonucleotide
cagaaggugucaaaagggaaa

SEQ ID NO: 11645 - RNA, 21 nt, Artificial Sequence
  Synthetic oligonucleotide
agaaggugucaaaagggaaag

SEQ ID NO: 11646 - RNA, 21 nt, Artificial Sequence
  Synthetic oligonucleotide
gaaggugucaaaagggaaagc

SEQ ID NO: 11647 - RNA, 21 nt, Artificial Sequence
  Synthetic oligonucleotide
aaggugucaaaagggaaagcu

SEQ ID NO: 11648 - RNA, 21 nt, Artificial Sequence
  Synthetic oligonucleotide
aggugucaaaagggaaagcua

SEQ ID NO: 11649 - RNA, 21 nt, Artificial Sequence
  Synthetic oligonucleotide
ggugucaaaagggaaagcuau

SEQ ID NO: 11650 - RNA, 21 nt, Artificial Sequence
  Synthetic oligonucleotide
gugucaaaagggaaagcuauu

SEQ ID NO: 11651 - RNA, 21 nt, Artificial Sequence
  Synthetic oligonucleotide
ugucaaaagggaaagcuauuc

SEQ ID NO: 11652 - RNA, 21 nt, Artificial Sequence
  Synthetic oligonucleotide
gucaaaagggaaagcuauucu

SEQ ID NO: 11653 - RNA, 21 nt, Artificial Sequence
  Synthetic oligonucleotide
ucaaaagggaaagcuauucug

SEQ ID NO: 11654 - RNA, 21 nt, Artificial Sequence
  Synthetic oligonucleotide
caaaagggaaagcuauucugg

SEQ ID NO: 11655 - RNA, 21 nt, Artificial Sequence
  Synthetic oligonucleotide
aaaagggaaagcuauucuggu

SEQ ID NO: 11656 - RNA, 21 nt, Artificial Sequence
  Synthetic oligonucleotide
uguuacuuuggauccuagggg

SEQ ID NO: 11657 - RNA, 21 nt, Artificial Sequence
  Synthetic oligonucleotide
guuacuuuggauccuaggggu

SEQ ID NO: 11658 - RNA, 21 nt, Artificial Sequence
  Synthetic oligonucleotide
uuacuuuggauccuaggggua

SEQ ID NO: 11659 - RNA, 21 nt, Artificial Sequence
  Synthetic oligonucleotide
uacuuuggauccuagggguau

SEQ ID NO: 11660 - RNA, 21 nt, Artificial Sequence
  Synthetic oligonucleotide
acuuuggauccuagggguauu

SEQ ID NO: 11661 - RNA, 21 nt, Artificial Sequence
  Synthetic oligonucleotide
cuuuggauccuagggguauuu

SEQ ID NO: 11662 - RNA, 21 nt, Artificial Sequence
  Synthetic oligonucleotide
uuuggauccuagggguauuua

SEQ ID NO: 11663 - RNA, 21 nt, Artificial Sequence
  Synthetic oligonucleotide
uuggauccuagggguauuuau

SEQ ID NO: 11664 - RNA, 21 nt, Artificial Sequence
  Synthetic oligonucleotide
uggauccuagggguauuuaug

SEQ ID NO: 11665 - RNA, 21 nt, Artificial Sequence
  Synthetic oligonucleotide
gacgaaaggaguucccauaca

SEQ ID NO: 11666 - RNA, 21 nt, Artificial Sequence
  Synthetic oligonucleotide
acgaaaggaguucccauacag

SEQ ID NO: 11667 - RNA, 21 nt, Artificial Sequence
  Synthetic oligonucleotide
cgaaaggaguucccauacagg

SEQ ID NO: 11668 - RNA, 21 nt, Artificial Sequence
  Synthetic oligonucleotide
gaaaggaguucccauacagga

SEQ ID NO: 11669 - RNA, 21 nt, Artificial Sequence
  Synthetic oligonucleotide
aaaggaguucccauacaggau

SEQ ID NO: 11670 - RNA, 21 nt, Artificial Sequence
  Synthetic oligonucleotide
aaggaguucccauacaggaua

SEQ ID NO: 11671 - RNA, 21 nt, Artificial Sequence
  Synthetic oligonucleotide
aggaguucccauacaggauac

SEQ ID NO: 11672 - RNA, 21 nt, Artificial Sequence
  Synthetic oligonucleotide
ggaguucccauacaggauacc

SEQ ID NO: 11673 - RNA, 21 nt, Artificial Sequence
  Synthetic oligonucleotide
ccuuagauuugguccccaaaa

SEQ ID NO: 11674 - RNA, 21 nt, Artificial Sequence
  Synthetic oligonucleotide
cuuagauuugguccccaaaac

SEQ ID NO: 11675 - RNA, 21 nt, Artificial Sequence
  Synthetic oligonucleotide
uuagauuugguccccaaaaca

SEQ ID NO: 11676 - RNA, 21 nt, Artificial Sequence
  Synthetic oligonucleotide
uagauuugguccccaaaacag

SEQ ID NO: 11677 - RNA, 21 nt, Artificial Sequence
  Synthetic oligonucleotide
agauuugguccccaaaacaga

SEQ ID NO: 11678 - RNA, 21 nt, Artificial Sequence
  Synthetic oligonucleotide
gauuugguccccaaaacagaa

SEQ ID NO: 11679 - RNA, 21 nt, Artificial Sequence
  Synthetic oligonucleotide
auuugguccccaaaacagaaa

SEQ ID NO: 11680 - RNA, 21 nt, Artificial Sequence
  Synthetic oligonucleotide
uuugguccccaaaacagaaau

SEQ ID NO: 11681 - RNA, 21 nt, Artificial Sequence
  Synthetic oligonucleotide
uugguccccaaaacagaaauc

SEQ ID NO: 11682 - RNA, 21 nt, Artificial Sequence
  Synthetic oligonucleotide
ugguccccaaaacagaaauca

SEQ ID NO: 11683 - RNA, 21 nt, Artificial Sequence
  Synthetic oligonucleotide
gguccccaaaacagaaaucaa

SEQ ID NO: 11684 - RNA, 21 nt, Artificial Sequence
  Synthetic oligonucleotide
guccccaaaacagaaaucaaa

SEQ ID NO: 11685 - RNA, 21 nt, Artificial Sequence
  Synthetic oligonucleotide
uccccaaaacagaaaucaaaa

SEQ ID NO: 11686 - RNA, 21 nt, Artificial Sequence
  Synthetic oligonucleotide
ccccaaaacagaaaucaaaag

SEQ ID NO: 11687 - RNA, 21 nt, Artificial Sequence
  Synthetic oligonucleotide
cccaaaacagaaaucaaaagg

SEQ ID NO: 11688 - RNA, 21 nt, Artificial Sequence
  Synthetic oligonucleotide
ccaaaacagaaaucaaaagga

SEQ ID NO: 11689 - RNA, 21 nt, Artificial Sequence
  Synthetic oligonucleotide
caaaacagaaaucaaaaggau

SEQ ID NO: 11690 - RNA, 21 nt, Artificial Sequence
  Synthetic oligonucleotide
aaaacagaaaucaaaaggauu

SEQ ID NO: 11691 - RNA, 21 nt, Artificial Sequence
  Synthetic oligonucleotide
aaacagaaaucaaaaggauuu

SEQ ID NO: 11692 - RNA, 21 nt, Artificial Sequence
  Synthetic oligonucleotide
aacagaaaucaaaaggauuuu

SEQ ID NO: 11693 - RNA, 21 nt, Artificial Sequence
  Synthetic oligonucleotide
agaaaucaaaaggauuuugag

SEQ ID NO: 11694 - RNA, 21 nt, Artificial Sequence
  Synthetic oligonucleotide
gaaaucaaaaggauuuugagu

SEQ ID NO: 11695 - RNA, 21 nt, Artificial Sequence
  Synthetic oligonucleotide
aaaucaaaaggauuuugagug

SEQ ID NO: 11696 - RNA, 21 nt, Artificial Sequence
  Synthetic oligonucleotide
aaucaaaaggauuuugagugu

SEQ ID NO: 11697 - RNA, 21 nt, Artificial Sequence
  Synthetic oligonucleotide
ucaaaaggauuuugaguguaa

SEQ ID NO: 11698 - RNA, 21 nt, Artificial Sequence
  Synthetic oligonucleotide
caaaaggauuuugaguguaaa

SEQ ID NO: 11699 - RNA, 21 nt, Artificial Sequence
  Synthetic oligonucleotide
aaaaggauuuugaguguaaaa

SEQ ID NO: 11700 - RNA, 21 nt, Artificial Sequence
  Synthetic oligonucleotide
aaaggauuuugaguguaaaag

SEQ ID NO: 11701 - RNA, 21 nt, Artificial Sequence
  Synthetic oligonucleotide
aaggauuuugaguguaaaagg

SEQ ID NO: 11702 - RNA, 21 nt, Artificial Sequence
  Synthetic oligonucleotide
aggauuuugaguguaaaagga

SEQ ID NO: 11703 - RNA, 21 nt, Artificial Sequence
  Synthetic oligonucleotide
ggauuuugaguguaaaaggac

SEQ ID NO: 11704 - RNA, 21 nt, Artificial Sequence
  Synthetic oligonucleotide
gauuuugaguguaaaaggacu

SEQ ID NO: 11705 - RNA, 21 nt, Artificial Sequence
  Synthetic oligonucleotide
auuuugaguguaaaaggacug

SEQ ID NO: 11706 - RNA, 21 nt, Artificial Sequence
  Synthetic oligonucleotide
uuuugaguguaaaaggacugc

SEQ ID NO: 11707 - RNA, 21 nt, Artificial Sequence
  Synthetic oligonucleotide
uuugaguguaaaaggacugcu

SEQ ID NO: 11708 - RNA, 21 nt, Artificial Sequence
  Synthetic oligonucleotide
uugaguguaaaaggacugcuu

SEQ ID NO: 11709 - RNA, 21 nt, Artificial Sequence
  Synthetic oligonucleotide
ugaguguaaaaggacugcuug

SEQ ID NO: 11710 - RNA, 21 nt, Artificial Sequence
  Synthetic oligonucleotide
gaguguaaaaggacugcuugu

SEQ ID NO: 11711 - RNA, 21 nt, Artificial Sequence
  Synthetic oligonucleotide
aguguaaaaggacugcuugua

SEQ ID NO: 11712 - RNA, 21 nt, Artificial Sequence
  Synthetic oligonucleotide
guguaaaaggacugcuuguag

SEQ ID NO: 11713 - RNA, 21 nt, Artificial Sequence
  Synthetic oligonucleotide
uguaaaaggacugcuuguagg

SEQ ID NO: 11714 - RNA, 21 nt, Artificial Sequence
  Synthetic oligonucleotide
guaaaaggacugcuuguaggu

SEQ ID NO: 11715 - RNA, 21 nt, Artificial Sequence
  Synthetic oligonucleotide
uaaaaggacugcuuguaggug

SEQ ID NO: 11716 - RNA, 21 nt, Artificial Sequence
  Synthetic oligonucleotide
aaaaggacugcuuguagguga

SEQ ID NO: 11717 - RNA, 21 nt, Artificial Sequence
  Synthetic oligonucleotide
aaaggacugcuuguaggugag

SEQ ID NO: 11718 - RNA, 21 nt, Artificial Sequence
  Synthetic oligonucleotide
aaggacugcuuguaggugaga

SEQ ID NO: 11719 - RNA, 21 nt, Artificial Sequence
  Synthetic oligonucleotide
aggacugcuuguaggugagau

SEQ ID NO: 11720 - RNA, 21 nt, Artificial Sequence
  Synthetic oligonucleotide
ggacugcuuguaggugagauc

SEQ ID NO: 11721 - RNA, 21 nt, Artificial Sequence
  Synthetic oligonucleotide
gacugcuuguaggugagaucu

SEQ ID NO: 11722 - RNA, 21 nt, Artificial Sequence
  Synthetic oligonucleotide
acugcuuguaggugagaucuu

SEQ ID NO: 11723 - RNA, 21 nt, Artificial Sequence
  Synthetic oligonucleotide
cugcuuguaggugagaucuug

SEQ ID NO: 11724 - RNA, 21 nt, Artificial Sequence
  Synthetic oligonucleotide
ugcuuguaggugagaucuugu

SEQ ID NO: 11725 - RNA, 21 nt, Artificial Sequence
  Synthetic oligonucleotide
gcuuguaggugagaucuuguc

SEQ ID NO: 11726 - RNA, 21 nt, Artificial Sequence
  Synthetic oligonucleotide
cuuguaggugagaucuugucu

SEQ ID NO: 11727 - RNA, 21 nt, Artificial Sequence
  Synthetic oligonucleotide
uuguaggugagaucuugucug

SEQ ID NO: 11728 - RNA, 21 nt, Artificial Sequence
  Synthetic oligonucleotide
uguaggugagaucuugucugc

SEQ ID NO: 11729 - RNA, 21 nt, Artificial Sequence
  Synthetic oligonucleotide
guaggugagaucuugucugca

SEQ ID NO: 11730 - RNA, 21 nt, Artificial Sequence
  Synthetic oligonucleotide
uaggugagaucuugucugcag

SEQ ID NO: 11731 - RNA, 21 nt, Artificial Sequence
  Synthetic oligonucleotide
aggugagaucuugucugcagu

SEQ ID NO: 11732 - RNA, 21 nt, Artificial Sequence
  Synthetic oligonucleotide
ggugagaucuugucugcaguu

SEQ ID NO: 11733 - RNA, 21 nt, Artificial Sequence
  Synthetic oligonucleotide
gugagaucuugucugcaguuc

SEQ ID NO: 11734 - RNA, 21 nt, Artificial Sequence
  Synthetic oligonucleotide
ugagaucuugucugcaguucu

SEQ ID NO: 11735 - RNA, 21 nt, Artificial Sequence
  Synthetic oligonucleotide
gagaucuugucugcaguucua

SEQ ID NO: 11736 - RNA, 21 nt, Artificial Sequence
  Synthetic oligonucleotide
agaucuugucugcaguucuaa

SEQ ID NO: 11737 - RNA, 21 nt, Artificial Sequence
  Synthetic oligonucleotide
gaucuugucugcaguucuaag

SEQ ID NO: 11738 - RNA, 21 nt, Artificial Sequence
  Synthetic oligonucleotide
aucuugucugcaguucuaagu

SEQ ID NO: 11739 - RNA, 21 nt, Artificial Sequence
  Synthetic oligonucleotide
ucuugucugcaguucuaaguc

SEQ ID NO: 11740 - RNA, 21 nt, Artificial Sequence
  Synthetic oligonucleotide
caggaaggcaucaauauccua

SEQ ID NO: 11741 - RNA, 21 nt, Artificial Sequence
  Synthetic oligonucleotide
aggaaggcaucaauauccuaa

SEQ ID NO: 11742 - RNA, 21 nt, Artificial Sequence
  Synthetic oligonucleotide
ggaaggcaucaauauccuaac

SEQ ID NO: 11743 - RNA, 21 nt, Artificial Sequence
  Synthetic oligonucleotide
gaaggcaucaauauccuaacc

SEQ ID NO: 11744 - RNA, 21 nt, Artificial Sequence
  Synthetic oligonucleotide
aaggcaucaauauccuaaccc

SEQ ID NO: 11745 - RNA, 21 nt, Artificial Sequence
  Synthetic oligonucleotide
aggcaucaauauccuaaccca

SEQ ID NO: 11746 - RNA, 21 nt, Artificial Sequence
  Synthetic oligonucleotide
ggcaucaauauccuaacccac

SEQ ID NO: 11747 - RNA, 21 nt, Artificial Sequence
  Synthetic oligonucleotide
gcaucaauauccuaacccacc

SEQ ID NO: 11748 - RNA, 21 nt, Artificial Sequence
  Synthetic oligonucleotide
caucaauauccuaacccaccu

SEQ ID NO: 11749 - RNA, 21 nt, Artificial Sequence
  Synthetic oligonucleotide
aucaauauccuaacccaccuc

SEQ ID NO: 11750 - RNA, 21 nt, Artificial Sequence
  Synthetic oligonucleotide
ucaauauccuaacccaccucc

SEQ ID NO: 11751 - RNA, 21 nt, Artificial Sequence
  Synthetic oligonucleotide
caauauccuaacccaccuccc

SEQ ID NO: 11752 - RNA, 21 nt, Artificial Sequence
  Synthetic oligonucleotide
aauauccuaacccaccucccc

SEQ ID NO: 11753 - RNA, 21 nt, Artificial Sequence
  Synthetic oligonucleotide
cuaacccaccuccccaaaggg

SEQ ID NO: 11754 - RNA, 21 nt, Artificial Sequence
  Synthetic oligonucleotide
uaacccaccuccccaaaggga

SEQ ID NO: 11755 - RNA, 21 nt, Artificial Sequence
  Synthetic oligonucleotide
aacccaccuccccaaagggag

SEQ ID NO: 11756 - RNA, 21 nt, Artificial Sequence
  Synthetic oligonucleotide
cagaggcggagcugaugagcg

SEQ ID NO: 11757 - RNA, 21 nt, Artificial Sequence
  Synthetic oligonucleotide
aggcggagcugaugagcguug

SEQ ID NO: 11758 - RNA, 21 nt, Artificial Sequence
  Synthetic oligonucleotide
ggcggagcugaugagcguugu

SEQ ID NO: 11759 - RNA, 21 nt, Artificial Sequence
  Synthetic oligonucleotide
gcggagcugaugagcguuguc

SEQ ID NO: 11760 - RNA, 21 nt, Artificial Sequence
  Synthetic oligonucleotide
cggagcugaugagcguugucc

SEQ ID NO: 11761 - RNA, 21 nt, Artificial Sequence
  Synthetic oligonucleotide
ggagcugaugagcguuguccc

SEQ ID NO: 11762 - RNA, 21 nt, Artificial Sequence
  Synthetic oligonucleotide
gagcugaugagcguuguccca

SEQ ID NO: 11763 - RNA, 21 nt, Artificial Sequence
  Synthetic oligonucleotide
agcugaugagcguugucccag

SEQ ID NO: 11764 - RNA, 21 nt, Artificial Sequence
  Synthetic oligonucleotide
gcugaugagcguugucccagu

SEQ ID NO: 11765 - RNA, 21 nt, Artificial Sequence
  Synthetic oligonucleotide
cugaugagcguugucccagua

SEQ ID NO: 11766 - RNA, 21 nt, Artificial Sequence
  Synthetic oligonucleotide
ugaugagcguugucccaguau

SEQ ID NO: 11767 - RNA, 21 nt, Artificial Sequence
  Synthetic oligonucleotide
gaugagcguugucccaguauu

SEQ ID NO: 11768 - RNA, 21 nt, Artificial Sequence
  Synthetic oligonucleotide
augagcguugucccaguauuc

SEQ ID NO: 11769 - RNA, 21 nt, Artificial Sequence
  Synthetic oligonucleotide
ugagcguugucccaguauucu

SEQ ID NO: 11770 - RNA, 21 nt, Artificial Sequence
  Synthetic oligonucleotide
gagcguugucccaguauucua

SEQ ID NO: 11771 - RNA, 21 nt, Artificial Sequence
  Synthetic oligonucleotide
agcguugucccaguauucuau

SEQ ID NO: 11772 - RNA, 21 nt, Artificial Sequence
  Synthetic oligonucleotide
gcguugucccaguauucuaug

SEQ ID NO: 11773 - RNA, 21 nt, Artificial Sequence
  Synthetic oligonucleotide
cguugucccaguauucuaugu

SEQ ID NO: 11774 - RNA, 21 nt, Artificial Sequence
  Synthetic oligonucleotide
guugucccaguauucuauguu

SEQ ID NO: 11775 - RNA, 21 nt, Artificial Sequence
  Synthetic oligonucleotide
uugucccaguauucuauguuu

SEQ ID NO: 11776 - RNA, 21 nt, Artificial Sequence
  Synthetic oligonucleotide
ugucccaguauucuauguuuu

SEQ ID NO: 11777 - RNA, 21 nt, Artificial Sequence
  Synthetic oligonucleotide
gucccaguauucuauguuuuu

SEQ ID NO: 11778 - RNA, 21 nt, Artificial Sequence
  Synthetic oligonucleotide
cccaguauucuauguuuuuca

SEQ ID NO: 11779 - RNA, 21 nt, Artificial Sequence
  Synthetic oligonucleotide
ccaguauucuauguuuuucac

SEQ ID NO: 11780 - RNA, 21 nt, Artificial Sequence
  Synthetic oligonucleotide
caguauucuauguuuuucacu

SEQ ID NO: 11781 - RNA, 21 nt, Artificial Sequence
  Synthetic oligonucleotide
aguauucuauguuuuucacua

SEQ ID NO: 11782 - RNA, 21 nt, Artificial Sequence
  Synthetic oligonucleotide
guauucuauguuuuucacuac

SEQ ID NO: 11783 - RNA, 21 nt, Artificial Sequence
  Synthetic oligonucleotide
uauucuauguuuuucacuacc

SEQ ID NO: 11784 - RNA, 21 nt, Artificial Sequence
  Synthetic oligonucleotide
auucuauguuuuucacuaccu

SEQ ID NO: 11785 - RNA, 21 nt, Artificial Sequence
  Synthetic oligonucleotide
uucuauguuuuucacuaccug

SEQ ID NO: 11786 - RNA, 21 nt, Artificial Sequence
  Synthetic oligonucleotide
ucuauguuuuucacuaccugg

SEQ ID NO: 11787 - RNA, 21 nt, Artificial Sequence
  Synthetic oligonucleotide
cuauguuuuucacuaccugga

SEQ ID NO: 11788 - RNA, 21 nt, Artificial Sequence
  Synthetic oligonucleotide
uauguuuuucacuaccuggaa

SEQ ID NO: 11789 - RNA, 21 nt, Artificial Sequence
  Synthetic oligonucleotide
auguuuuucacuaccuggaaa

SEQ ID NO: 11790 - RNA, 21 nt, Artificial Sequence
  Synthetic oligonucleotide
uguuuuucacuaccuggaaac

SEQ ID NO: 11791 - RNA, 21 nt, Artificial Sequence
  Synthetic oligonucleotide
guuuuucacuaccuggaaaca

SEQ ID NO: 11792 - RNA, 21 nt, Artificial Sequence
  Synthetic oligonucleotide
uuuuucacuaccuggaaacag

SEQ ID NO: 11793 - RNA, 21 nt, Artificial Sequence
  Synthetic oligonucleotide
uuuucacuaccuggaaacagg

SEQ ID NO: 11794 - RNA, 21 nt, Artificial Sequence
  Synthetic oligonucleotide
uuucacuaccuggaaacagga

SEQ ID NO: 11795 - RNA, 21 nt, Artificial Sequence
  Synthetic oligonucleotide
uucacuaccuggaaacaggaa

SEQ ID NO: 11796 - RNA, 21 nt, Artificial Sequence
  Synthetic oligonucleotide
ucacuaccuggaaacaggaaa

SEQ ID NO: 11797 - RNA, 21 nt, Artificial Sequence
  Synthetic oligonucleotide
cacuaccuggaaacaggaaau

SEQ ID NO: 11798 - RNA, 21 nt, Artificial Sequence
  Synthetic oligonucleotide
acuaccuggaaacaggaaauc

SEQ ID NO: 11799 - RNA, 21 nt, Artificial Sequence
  Synthetic oligonucleotide
cuaccuggaaacaggaaauca

SEQ ID NO: 11800 - RNA, 21 nt, Artificial Sequence
  Synthetic oligonucleotide
uaccuggaaacaggaaaucau

SEQ ID NO: 11801 - RNA, 21 nt, Artificial Sequence
  Synthetic oligonucleotide
accuggaaacaggaaaucauu

SEQ ID NO: 11802 - RNA, 21 nt, Artificial Sequence
  Synthetic oligonucleotide
ccuggaaacaggaaaucauug

SEQ ID NO: 11803 - RNA, 21 nt, Artificial Sequence
  Synthetic oligonucleotide
cuggaaacaggaaaucauugg

SEQ ID NO: 11804 - RNA, 21 nt, Artificial Sequence
  Synthetic oligonucleotide
uggaaacaggaaaucauugga

SEQ ID NO: 11805 - RNA, 21 nt, Artificial Sequence
  Synthetic oligonucleotide
ggaaacaggaaaucauuggaa

SEQ ID NO: 11806 - RNA, 21 nt, Artificial Sequence
  Synthetic oligonucleotide
gaaacaggaaaucauuggaac

SEQ ID NO: 11807 - RNA, 21 nt, Artificial Sequence
  Synthetic oligonucleotide
aaacaggaaaucauuggaaca

SEQ ID NO: 11808 - RNA, 21 nt, Artificial Sequence
  Synthetic oligonucleotide
aacaggaaaucauuggaacau

SEQ ID NO: 11809 - RNA, 21 nt, Artificial Sequence
  Synthetic oligonucleotide
aggaaaucauuggaacauuuu

SEQ ID NO: 11810 - RNA, 21 nt, Artificial Sequence
  Synthetic oligonucleotide
ggaaaucauuggaacauuuuu

SEQ ID NO: 11811 - RNA, 21 nt, Artificial Sequence
  Synthetic oligonucleotide
gaaaucauuggaacauuuuuc

SEQ ID NO: 11812 - RNA, 21 nt, Artificial Sequence
  Synthetic oligonucleotide
aaaucauuggaacauuuuuca

SEQ ID NO: 11813 - RNA, 21 nt, Artificial Sequence
  Synthetic oligonucleotide
aaucauuggaacauuuuucau

SEQ ID NO: 11814 - RNA, 21 nt, Artificial Sequence
  Synthetic oligonucleotide
aucauuggaacauuuuucauu

SEQ ID NO: 11815 - RNA, 21 nt, Artificial Sequence
  Synthetic oligonucleotide
ucauuggaacauuuuucauuc

SEQ ID NO: 11816 - RNA, 21 nt, Artificial Sequence
  Synthetic oligonucleotide
cugacccauuaauugaaaagc

SEQ ID NO: 11817 - RNA, 21 nt, Artificial Sequence
  Synthetic oligonucleotide
gaagaaaaaauuaaaagaagg

SEQ ID NO: 11818 - RNA, 21 nt, Artificial Sequence
  Synthetic oligonucleotide
aagaaaaaauuaaaagaaggg

SEQ ID NO: 11819 - RNA, 21 nt, Artificial Sequence
  Synthetic oligonucleotide
agaaaaaauuaaaagaaggga

SEQ ID NO: 11820 - RNA, 21 nt, Artificial Sequence
  Synthetic oligonucleotide
gaaaaaauuaaaagaagggau

SEQ ID NO: 11821 - RNA, 21 nt, Artificial Sequence
  Synthetic oligonucleotide
aaaaaauuaaaagaagggaug

SEQ ID NO: 11822 - RNA, 21 nt, Artificial Sequence
  Synthetic oligonucleotide
guugagcauuauguccuacag

SEQ ID NO: 11823 - RNA, 21 nt, Artificial Sequence
  Synthetic oligonucleotide
ugagcauuauguccuacagaa

SEQ ID NO: 11824 - RNA, 21 nt, Artificial Sequence
  Synthetic oligonucleotide
gagcauuauguccuacagaaa

SEQ ID NO: 11825 - RNA, 21 nt, Artificial Sequence
  Synthetic oligonucleotide
agcauuauguccuacagaaau

SEQ ID NO: 11826 - RNA, 21 nt, Artificial Sequence
  Synthetic oligonucleotide
gcauuauguccuacagaaaug

SEQ ID NO: 11827 - RNA, 21 nt, Artificial Sequence
  Synthetic oligonucleotide
cauuauguccuacagaaaugc

SEQ ID NO: 11828 - RNA, 21 nt, Artificial Sequence
  Synthetic oligonucleotide
auuauguccuacagaaaugcu

SEQ ID NO: 11829 - RNA, 21 nt, Artificial Sequence
  Synthetic oligonucleotide
uuauguccuacagaaaugcug

SEQ ID NO: 11830 - RNA, 21 nt, Artificial Sequence
  Synthetic oligonucleotide
uauguccuacagaaaugcuga

SEQ ID NO: 11831 - RNA, 21 nt, Artificial Sequence
  Synthetic oligonucleotide
auguccuacagaaaugcugac

SEQ ID NO: 11832 - RNA, 21 nt, Artificial Sequence
  Synthetic oligonucleotide
uguccuacagaaaugcugacu

SEQ ID NO: 11833 - RNA, 21 nt, Artificial Sequence
  Synthetic oligonucleotide
guccuacagaaaugcugacua

SEQ ID NO: 11834 - RNA, 21 nt, Artificial Sequence
  Synthetic oligonucleotide
gaagugcuagcacuugguuaa

SEQ ID NO: 11835 - RNA, 21 nt, Artificial Sequence
  Synthetic oligonucleotide
aagugcuagcacuugguuaac

SEQ ID NO: 11836 - RNA, 21 nt, Artificial Sequence
  Synthetic oligonucleotide
agugcuagcacuugguuaaca

SEQ ID NO: 11837 - RNA, 21 nt, Artificial Sequence
  Synthetic oligonucleotide
gugcuagcacuugguuaacag

SEQ ID NO: 11838 - RNA, 21 nt, Artificial Sequence
  Synthetic oligonucleotide
ugcuagcacuugguuaacagc

SEQ ID NO: 11839 - RNA, 21 nt, Artificial Sequence
  Synthetic oligonucleotide
gcuagcacuugguuaacagcu

SEQ ID NO: 11840 - RNA, 21 nt, Artificial Sequence
  Synthetic oligonucleotide
cuagcacuugguuaacagcuu

SEQ ID NO: 11841 - RNA, 21 nt, Artificial Sequence
  Synthetic oligonucleotide
uagcacuugguuaacagcuuu

SEQ ID NO: 11842 - RNA, 21 nt, Artificial Sequence
  Synthetic oligonucleotide
agcacuugguuaacagcuuuu

SEQ ID NO: 11843 - RNA, 21 nt, Artificial Sequence
  Synthetic oligonucleotide
gcacuugguuaacagcuuuug

SEQ ID NO: 11844 - RNA, 21 nt, Artificial Sequence
  Synthetic oligonucleotide
acuugguuaacagcuuuugcu

SEQ ID NO: 11845 - RNA, 21 nt, Artificial Sequence
  Synthetic oligonucleotide
cuugguuaacagcuuuugcuu

SEQ ID NO: 11846 - RNA, 21 nt, Artificial Sequence
  Synthetic oligonucleotide
gguuaacagcuuuugcuuuaa

SEQ ID NO: 11847 - RNA, 21 nt, Artificial Sequence
  Synthetic oligonucleotide
guuaacagcuuuugcuuuaag

SEQ ID NO: 11848 - RNA, 21 nt, Artificial Sequence
  Synthetic oligonucleotide
uuaacagcuuuugcuuuaaga

SEQ ID NO: 11849 - RNA, 21 nt, Artificial Sequence
  Synthetic oligonucleotide
uaacagcuuuugcuuuaagag

SEQ ID NO: 11850 - RNA, 21 nt, Artificial Sequence
  Synthetic oligonucleotide
aacagcuuuugcuuuaagagu

SEQ ID NO: 11851 - RNA, 21 nt, Artificial Sequence
  Synthetic oligonucleotide
acagcuuuugcuuuaagagua

SEQ ID NO: 11852 - RNA, 21 nt, Artificial Sequence
  Synthetic oligonucleotide
cagcuuuugcuuuaagaguac

SEQ ID NO: 11853 - RNA, 21 nt, Artificial Sequence
  Synthetic oligonucleotide
agcuuuugcuuuaagaguacu

SEQ ID NO: 11854 - RNA, 21 nt, Artificial Sequence
  Synthetic oligonucleotide
gcuuuugcuuuaagaguacuu

SEQ ID NO: 11855 - RNA, 21 nt, Artificial Sequence
  Synthetic oligonucleotide
cuuuugcuuuaagaguacuug

SEQ ID NO: 11856 - RNA, 21 nt, Artificial Sequence
  Synthetic oligonucleotide
uuuugcuuuaagaguacuugg

SEQ ID NO: 11857 - RNA, 21 nt, Artificial Sequence
  Synthetic oligonucleotide
uuugcuuuaagaguacuugga

SEQ ID NO: 11858 - RNA, 21 nt, Artificial Sequence
  Synthetic oligonucleotide
gcuuuaagaguacuuggacaa

SEQ ID NO: 11859 - RNA, 21 nt, Artificial Sequence
  Synthetic oligonucleotide
cuuuaagaguacuuggacaag

SEQ ID NO: 11860 - RNA, 21 nt, Artificial Sequence
  Synthetic oligonucleotide
acguagagcagaaccaaaauu

SEQ ID NO: 11861 - RNA, 21 nt, Artificial Sequence
  Synthetic oligonucleotide
uuuguaauucuuuauuguggc

SEQ ID NO: 11862 - RNA, 21 nt, Artificial Sequence
  Synthetic oligonucleotide
uuguaauucuuuauuguggcu

SEQ ID NO: 11863 - RNA, 21 nt, Artificial Sequence
  Synthetic oligonucleotide
cuuucaaggaaaauucacagu

SEQ ID NO: 11864 - RNA, 21 nt, Artificial Sequence
  Synthetic oligonucleotide
uuucaaggaaaauucacagua

SEQ ID NO: 11865 - RNA, 21 nt, Artificial Sequence
  Synthetic oligonucleotide
uucaaggaaaauucacaguau

SEQ ID NO: 11866 - RNA, 21 nt, Artificial Sequence
  Synthetic oligonucleotide
ucaaggaaaauucacaguauc

SEQ ID NO: 11867 - RNA, 21 nt, Artificial Sequence
  Synthetic oligonucleotide
caaggaaaauucacaguauca

SEQ ID NO: 11868 - RNA, 21 nt, Artificial Sequence
  Synthetic oligonucleotide
aaggaaaauucacaguaucaa

SEQ ID NO: 11869 - RNA, 21 nt, Artificial Sequence
  Synthetic oligonucleotide
aggaaaauucacaguaucaac

SEQ ID NO: 11870 - RNA, 21 nt, Artificial Sequence
  Synthetic oligonucleotide
ggaaaauucacaguaucaacc

SEQ ID NO: 11871 - RNA, 21 nt, Artificial Sequence
  Synthetic oligonucleotide
gaaaauucacaguaucaacca

SEQ ID NO: 11872 - RNA, 21 nt, Artificial Sequence
  Synthetic oligonucleotide
aaaauucacaguaucaaccaa

SEQ ID NO: 11873 - RNA, 21 nt, Artificial Sequence
  Synthetic oligonucleotide
aaauucacaguaucaaccaau

SEQ ID NO: 11874 - RNA, 21 nt, Artificial Sequence
  Synthetic oligonucleotide
aauucacaguaucaaccaaua

SEQ ID NO: 11875 - RNA, 21 nt, Artificial Sequence
  Synthetic oligonucleotide
auucacaguaucaaccaauaa

SEQ ID NO: 11876 - RNA, 21 nt, Artificial Sequence
  Synthetic oligonucleotide
ucacaguaucaaccaauaaaa

SEQ ID NO: 11877 - RNA, 21 nt, Artificial Sequence
  Synthetic oligonucleotide
cacaguaucaaccaauaaaau

SEQ ID NO: 11878 - RNA, 21 nt, Artificial Sequence
  Synthetic oligonucleotide
acaguaucaaccaauaaaauu

SEQ ID NO: 11879 - RNA, 21 nt, Artificial Sequence
  Synthetic oligonucleotide
caguaucaaccaauaaaauua

SEQ ID NO: 11880 - RNA, 21 nt, Artificial Sequence
  Synthetic oligonucleotide
aguaucaaccaauaaaauuac

SEQ ID NO: 11881 - RNA, 21 nt, Artificial Sequence
  Synthetic oligonucleotide
guaucaaccaauaaaauuaca

SEQ ID NO: 11882 - RNA, 21 nt, Artificial Sequence
  Synthetic oligonucleotide
uaucaaccaauaaaauuacag

SEQ ID NO: 11883 - RNA, 21 nt, Artificial Sequence
  Synthetic oligonucleotide
cacagcucuaauuaaagcuga

SEQ ID NO: 11884 - RNA, 21 nt, Artificial Sequence
  Synthetic oligonucleotide
acagcucuaauuaaagcugac

SEQ ID NO: 11885 - RNA, 21 nt, Artificial Sequence
  Synthetic oligonucleotide
cagcucuaauuaaagcugaca

SEQ ID NO: 11886 - RNA, 21 nt, Artificial Sequence
  Synthetic oligonucleotide
aacuuucugcuugaaaauaca

SEQ ID NO: 11887 - RNA, 21 nt, Artificial Sequence
  Synthetic oligonucleotide
acuuucugcuugaaaauacac

SEQ ID NO: 11888 - RNA, 21 nt, Artificial Sequence
  Synthetic oligonucleotide
cuuucugcuugaaaauacacu

SEQ ID NO: 11889 - RNA, 21 nt, Artificial Sequence
  Synthetic oligonucleotide
uuucugcuugaaaauacacug

SEQ ID NO: 11890 - RNA, 21 nt, Artificial Sequence
  Synthetic oligonucleotide
uucugcuugaaaauacacugc

SEQ ID NO: 11891 - RNA, 21 nt, Artificial Sequence
  Synthetic oligonucleotide
ucugcuugaaaauacacugcc

SEQ ID NO: 11892 - RNA, 21 nt, Artificial Sequence
  Synthetic oligonucleotide
cugcuugaaaauacacugcca

SEQ ID NO: 11893 - RNA, 21 nt, Artificial Sequence
  Synthetic oligonucleotide
ugcuugaaaauacacugccag

SEQ ID NO: 11894 - RNA, 21 nt, Artificial Sequence
  Synthetic oligonucleotide
gcuugaaaauacacugccagc

SEQ ID NO: 11895 - RNA, 21 nt, Artificial Sequence
  Synthetic oligonucleotide
cuugaaaauacacugccagcc

SEQ ID NO: 11896 - RNA, 21 nt, Artificial Sequence
  Synthetic oligonucleotide
uugaaaauacacugccagccc

SEQ ID NO: 11897 - RNA, 21 nt, Artificial Sequence
  Synthetic oligonucleotide
ugaaaauacacugccagccca

SEQ ID NO: 11898 - RNA, 21 nt, Artificial Sequence
  Synthetic oligonucleotide
gaaaauacacugccagcccag

SEQ ID NO: 11899 - RNA, 21 nt, Artificial Sequence
  Synthetic oligonucleotide
aaaauacacugccagcccaga

SEQ ID NO: 11900 - RNA, 21 nt, Artificial Sequence
  Synthetic oligonucleotide
aaauacacugccagcccagag

SEQ ID NO: 11901 - RNA, 21 nt, Artificial Sequence
  Synthetic oligonucleotide
aauacacugccagcccagagc

SEQ ID NO: 11902 - RNA, 21 nt, Artificial Sequence
  Synthetic oligonucleotide
auacacugccagcccagagca

SEQ ID NO: 11903 - RNA, 21 nt, Artificial Sequence
  Synthetic oligonucleotide
uacacugccagcccagagcac

SEQ ID NO: 11904 - RNA, 21 nt, Artificial Sequence
  Synthetic oligonucleotide
acacugccagcccagagcacc

SEQ ID NO: 11905 - RNA, 21 nt, Artificial Sequence
  Synthetic oligonucleotide
cacugccagcccagagcaccu

SEQ ID NO: 11906 - RNA, 21 nt, Artificial Sequence
  Synthetic oligonucleotide
acugccagcccagagcaccuu

SEQ ID NO: 11907 - RNA, 21 nt, Artificial Sequence
  Synthetic oligonucleotide
cugccagcccagagcaccuuu

SEQ ID NO: 11908 - RNA, 21 nt, Artificial Sequence
  Synthetic oligonucleotide
ugccagcccagagcaccuuua

SEQ ID NO: 11909 - RNA, 21 nt, Artificial Sequence
  Synthetic oligonucleotide
gccagcccagagcaccuuuac

SEQ ID NO: 11910 - RNA, 21 nt, Artificial Sequence
  Synthetic oligonucleotide
ccagcccagagcaccuuuaca

SEQ ID NO: 11911 - RNA, 21 nt, Artificial Sequence
  Synthetic oligonucleotide
cagcccagagcaccuuuacau

SEQ ID NO: 11912 - RNA, 21 nt, Artificial Sequence
  Synthetic oligonucleotide
agcccagagcaccuuuacauu

SEQ ID NO: 11913 - RNA, 21 nt, Artificial Sequence
  Synthetic oligonucleotide
gcccagagcaccuuuacauug

SEQ ID NO: 11914 - RNA, 21 nt, Artificial Sequence
  Synthetic oligonucleotide
cccagagcaccuuuacauugg

SEQ ID NO: 11915 - RNA, 21 nt, Artificial Sequence
  Synthetic oligonucleotide
ccagagcaccuuuacauuggc

SEQ ID NO: 11916 - RNA, 21 nt, Artificial Sequence
  Synthetic oligonucleotide
cagagcaccuuuacauuggcc

SEQ ID NO: 11917 - RNA, 21 nt, Artificial Sequence
  Synthetic oligonucleotide
agagcaccuuuacauuggcca

SEQ ID NO: 11918 - RNA, 21 nt, Artificial Sequence
  Synthetic oligonucleotide
gagcaccuuuacauuggccau

SEQ ID NO: 11919 - RNA, 21 nt, Artificial Sequence
  Synthetic oligonucleotide
agcaccuuuacauuggccauu

SEQ ID NO: 11920 - RNA, 21 nt, Artificial Sequence
  Synthetic oligonucleotide
gcaccuuuacauuggccauuu

SEQ ID NO: 11921 - RNA, 21 nt, Artificial Sequence
  Synthetic oligonucleotide
caccuuuacauuggccauuuc

SEQ ID NO: 11922 - RNA, 21 nt, Artificial Sequence
  Synthetic oligonucleotide
accuuuacauuggccauuucu

SEQ ID NO: 11923 - RNA, 21 nt, Artificial Sequence
  Synthetic oligonucleotide
ccuuuacauuggccauuucug

SEQ ID NO: 11924 - RNA, 21 nt, Artificial Sequence
  Synthetic oligonucleotide
cuuuacauuggccauuucugc

SEQ ID NO: 11925 - RNA, 21 nt, Artificial Sequence
  Synthetic oligonucleotide
cguaugcucuuucccugggag

SEQ ID NO: 11926 - RNA, 21 nt, Artificial Sequence
  Synthetic oligonucleotide
guaugcucuuucccugggaga

SEQ ID NO: 11927 - RNA, 21 nt, Artificial Sequence
  Synthetic oligonucleotide
uaugcucuuucccugggagau

SEQ ID NO: 11928 - RNA, 21 nt, Artificial Sequence
  Synthetic oligonucleotide
augcucuuucccugggagaua

SEQ ID NO: 11929 - RNA, 21 nt, Artificial Sequence
  Synthetic oligonucleotide
ugcucuuucccugggagauaa

SEQ ID NO: 11930 - RNA, 21 nt, Artificial Sequence
  Synthetic oligonucleotide
gcucuuucccugggagauaaa

SEQ ID NO: 11931 - RNA, 21 nt, Artificial Sequence
  Synthetic oligonucleotide
cucuuucccugggagauaaaa

SEQ ID NO: 11932 - RNA, 21 nt, Artificial Sequence
  Synthetic oligonucleotide
ucuuucccugggagauaaaac

SEQ ID NO: 11933 - RNA, 21 nt, Artificial Sequence
  Synthetic oligonucleotide
cuuucccugggagauaaaacu

SEQ ID NO: 11934 - RNA, 21 nt, Artificial Sequence
  Synthetic oligonucleotide
uuucccugggagauaaaacuc

SEQ ID NO: 11935 - RNA, 21 nt, Artificial Sequence
  Synthetic oligonucleotide
uucccugggagauaaaacuca

SEQ ID NO: 11936 - RNA, 21 nt, Artificial Sequence
  Synthetic oligonucleotide
ucccugggagauaaaacucac

SEQ ID NO: 11937 - RNA, 21 nt, Artificial Sequence
  Synthetic oligonucleotide
cccugggagauaaaacucacc

SEQ ID NO: 11938 - RNA, 21 nt, Artificial Sequence
  Synthetic oligonucleotide
ccugggagauaaaacucaccc

SEQ ID NO: 11939 - RNA, 21 nt, Artificial Sequence
  Synthetic oligonucleotide
cugggagauaaaacucaccca

SEQ ID NO: 11940 - RNA, 21 nt, Artificial Sequence
  Synthetic oligonucleotide
ugggagauaaaacucacccac

SEQ ID NO: 11941 - RNA, 21 nt, Artificial Sequence
  Synthetic oligonucleotide
gggagauaaaacucacccaca

SEQ ID NO: 11942 - RNA, 21 nt, Artificial Sequence
  Synthetic oligonucleotide
ggagauaaaacucacccacag

SEQ ID NO: 11943 - RNA, 21 nt, Artificial Sequence
  Synthetic oligonucleotide
gagauaaaacucacccacagu

SEQ ID NO: 11944 - RNA, 21 nt, Artificial Sequence
  Synthetic oligonucleotide
agauaaaacucacccacaguu

SEQ ID NO: 11945 - RNA, 21 nt, Artificial Sequence
  Synthetic oligonucleotide
gauaaaacucacccacaguuu

SEQ ID NO: 11946 - RNA, 21 nt, Artificial Sequence
  Synthetic oligonucleotide
ucguucaauuguuucagcuuu

SEQ ID NO: 11947 - RNA, 21 nt, Artificial Sequence
  Synthetic oligonucleotide
guucaauuguuucagcuuuga

SEQ ID NO: 11948 - RNA, 21 nt, Artificial Sequence
  Synthetic oligonucleotide
uucaauuguuucagcuuugaa

SEQ ID NO: 11949 - RNA, 21 nt, Artificial Sequence
  Synthetic oligonucleotide
ucaauuguuucagcuuugaag

SEQ ID NO: 11950 - RNA, 21 nt, Artificial Sequence
  Synthetic oligonucleotide
caauuguuucagcuuugaaga

SEQ ID NO: 11951 - RNA, 21 nt, Artificial Sequence
  Synthetic oligonucleotide
aauuguuucagcuuugaagag

SEQ ID NO: 11952 - RNA, 21 nt, Artificial Sequence
  Synthetic oligonucleotide
auuguuucagcuuugaagaga

SEQ ID NO: 11953 - RNA, 21 nt, Artificial Sequence
  Synthetic oligonucleotide
uuguuucagcuuugaagagag

SEQ ID NO: 11954 - RNA, 21 nt, Artificial Sequence
  Synthetic oligonucleotide
uguuucagcuuugaagagaga

SEQ ID NO: 11955 - RNA, 21 nt, Artificial Sequence
  Synthetic oligonucleotide
guuucagcuuugaagagagaa

SEQ ID NO: 11956 - RNA, 21 nt, Artificial Sequence
  Synthetic oligonucleotide
uuucagcuuugaagagagaag

SEQ ID NO: 11957 - RNA, 21 nt, Artificial Sequence
  Synthetic oligonucleotide
uucagcuuugaagagagaagc

SEQ ID NO: 11958 - RNA, 21 nt, Artificial Sequence
  Synthetic oligonucleotide
ucagcuuugaagagagaagcu

SEQ ID NO: 11959 - RNA, 21 nt, Artificial Sequence
  Synthetic oligonucleotide
cagcuuugaagagagaagcuu

SEQ ID NO: 11960 - RNA, 21 nt, Artificial Sequence
  Synthetic oligonucleotide
agcuuugaagagagaagcuuu

SEQ ID NO: 11961 - RNA, 21 nt, Artificial Sequence
  Synthetic oligonucleotide
gcuuugaagagagaagcuuug

SEQ ID NO: 11962 - RNA, 21 nt, Artificial Sequence
  Synthetic oligonucleotide
cuuugaagagagaagcuuugg

SEQ ID NO: 11963 - RNA, 21 nt, Artificial Sequence
  Synthetic oligonucleotide
uuugaagagagaagcuuuggu

SEQ ID NO: 11964 - RNA, 21 nt, Artificial Sequence
  Synthetic oligonucleotide
aagagagaagcuuugguuaaa

SEQ ID NO: 11965 - RNA, 21 nt, Artificial Sequence
  Synthetic oligonucleotide
agagagaagcuuugguuaaag

SEQ ID NO: 11966 - RNA, 21 nt, Artificial Sequence
  Synthetic oligonucleotide
gagagaagcuuugguuaaagg

SEQ ID NO: 11967 - RNA, 21 nt, Artificial Sequence
  Synthetic oligonucleotide
agaagcuuugguuaaagguaa

SEQ ID NO: 11968 - RNA, 21 nt, Artificial Sequence
  Synthetic oligonucleotide
gaagcuuugguuaaagguaau

SEQ ID NO: 11969 - RNA, 21 nt, Artificial Sequence
  Synthetic oligonucleotide
aagcuuugguuaaagguaauc

SEQ ID NO: 11970 - RNA, 21 nt, Artificial Sequence
  Synthetic oligonucleotide
agcuuugguuaaagguaaucc

SEQ ID NO: 11971 - RNA, 21 nt, Artificial Sequence
  Synthetic oligonucleotide
gcuuugguuaaagguaaucca

SEQ ID NO: 11972 - RNA, 21 nt, Artificial Sequence
  Synthetic oligonucleotide
cuuugguuaaagguaauccac

SEQ ID NO: 11973 - RNA, 21 nt, Artificial Sequence
  Synthetic oligonucleotide
uuugguuaaagguaauccacc

SEQ ID NO: 11974 - RNA, 21 nt, Artificial Sequence
  Synthetic oligonucleotide
uugguuaaagguaauccaccc

SEQ ID NO: 11975 - RNA, 21 nt, Artificial Sequence
  Synthetic oligonucleotide
ugguuaaagguaauccaccca

SEQ ID NO: 11976 - RNA, 21 nt, Artificial Sequence
  Synthetic oligonucleotide
gguuaaagguaauccacccau

SEQ ID NO: 11977 - RNA, 21 nt, Artificial Sequence
  Synthetic oligonucleotide
guuaaagguaauccacccauu

SEQ ID NO: 11978 - RNA, 21 nt, Artificial Sequence
  Synthetic oligonucleotide
uuaaagguaauccacccauuu

SEQ ID NO: 11979 - RNA, 21 nt, Artificial Sequence
  Synthetic oligonucleotide
uaaagguaauccacccauuua

SEQ ID NO: 11980 - RNA, 21 nt, Artificial Sequence
  Synthetic oligonucleotide
aaagguaauccacccauuuau

SEQ ID NO: 11981 - RNA, 21 nt, Artificial Sequence
  Synthetic oligonucleotide
aagguaauccacccauuuauc

SEQ ID NO: 11982 - RNA, 21 nt, Artificial Sequence
  Synthetic oligonucleotide
agguaauccacccauuuaucg

SEQ ID NO: 11983 - RNA, 21 nt, Artificial Sequence
  Synthetic oligonucleotide
gguaauccacccauuuaucgu

SEQ ID NO: 11984 - RNA, 21 nt, Artificial Sequence
  Synthetic oligonucleotide
guaauccacccauuuaucguu

SEQ ID NO: 11985 - RNA, 21 nt, Artificial Sequence
  Synthetic oligonucleotide
uaauccacccauuuaucguuu

SEQ ID NO: 11986 - RNA, 21 nt, Artificial Sequence
  Synthetic oligonucleotide
aauccacccauuuaucguuuu

SEQ ID NO: 11987 - RNA, 21 nt, Artificial Sequence
  Synthetic oligonucleotide
auccacccauuuaucguuuuu

SEQ ID NO: 11988 - RNA, 21 nt, Artificial Sequence
  Synthetic oligonucleotide
uccacccauuuaucguuuuug

SEQ ID NO: 11989 - RNA, 21 nt, Artificial Sequence
  Synthetic oligonucleotide
ccacccauuuaucguuuuugg

SEQ ID NO: 11990 - RNA, 21 nt, Artificial Sequence
  Synthetic oligonucleotide
cacccauuuaucguuuuugga

SEQ ID NO: 11991 - RNA, 21 nt, Artificial Sequence
  Synthetic oligonucleotide
cccauuuaucguuuuuggaaa

SEQ ID NO: 11992 - RNA, 21 nt, Artificial Sequence
  Synthetic oligonucleotide
ccauuuaucguuuuuggaaag

SEQ ID NO: 11993 - RNA, 21 nt, Artificial Sequence
  Synthetic oligonucleotide
cauuuaucguuuuuggaaaga

SEQ ID NO: 11994 - RNA, 21 nt, Artificial Sequence
  Synthetic oligonucleotide
auuuaucguuuuuggaaagac

SEQ ID NO: 11995 - RNA, 21 nt, Artificial Sequence
  Synthetic oligonucleotide
uuuaucguuuuuggaaagaca

SEQ ID NO: 11996 - RNA, 21 nt, Artificial Sequence
  Synthetic oligonucleotide
agcauaaagacagcucuguac

SEQ ID NO: 11997 - RNA, 21 nt, Artificial Sequence
  Synthetic oligonucleotide
gcauaaagacagcucuguacc

SEQ ID NO: 11998 - RNA, 21 nt, Artificial Sequence
  Synthetic oligonucleotide
cauaaagacagcucuguaccu

SEQ ID NO: 11999 - RNA, 21 nt, Artificial Sequence
  Synthetic oligonucleotide
auaaagacagcucuguaccua

SEQ ID NO: 12000 - RNA, 21 nt, Artificial Sequence
  Synthetic oligonucleotide
uaaagacagcucuguaccuaa

SEQ ID NO: 12001 - RNA, 21 nt, Artificial Sequence
  Synthetic oligonucleotide
aaagacagcucuguaccuaac

SEQ ID NO: 12002 - RNA, 21 nt, Artificial Sequence
  Synthetic oligonucleotide
aagacagcucuguaccuaaca

SEQ ID NO: 12003 - RNA, 21 nt, Artificial Sequence
  Synthetic oligonucleotide
agacagcucuguaccuaacac

SEQ ID NO: 12004 - RNA, 21 nt, Artificial Sequence
  Synthetic oligonucleotide
gacagcucuguaccuaacacu

SEQ ID NO: 12005 - RNA, 21 nt, Artificial Sequence
  Synthetic oligonucleotide
acagcucuguaccuaacacug

SEQ ID NO: 12006 - RNA, 21 nt, Artificial Sequence
  Synthetic oligonucleotide
cagcucuguaccuaacacugg

SEQ ID NO: 12007 - RNA, 21 nt, Artificial Sequence
  Synthetic oligonucleotide
agcucuguaccuaacacuggu

SEQ ID NO: 12008 - RNA, 21 nt, Artificial Sequence
  Synthetic oligonucleotide
gcucuguaccuaacacuggua

SEQ ID NO: 12009 - RNA, 21 nt, Artificial Sequence
  Synthetic oligonucleotide
cucuguaccuaacacugguac

SEQ ID NO: 12010 - RNA, 21 nt, Artificial Sequence
  Synthetic oligonucleotide
cggcacguaugguagaaacaa

SEQ ID NO: 12011 - RNA, 21 nt, Artificial Sequence
  Synthetic oligonucleotide
ggcacguaugguagaaacaac

SEQ ID NO: 12012 - RNA, 21 nt, Artificial Sequence
  Synthetic oligonucleotide
gcacguaugguagaaacaacu

SEQ ID NO: 12013 - RNA, 21 nt, Artificial Sequence
  Synthetic oligonucleotide
cacguaugguagaaacaacug

SEQ ID NO: 12014 - RNA, 21 nt, Artificial Sequence
  Synthetic oligonucleotide
acguaugguagaaacaacugc

SEQ ID NO: 12015 - RNA, 21 nt, Artificial Sequence
  Synthetic oligonucleotide
cguaugguagaaacaacugcc

SEQ ID NO: 12016 - RNA, 21 nt, Artificial Sequence
  Synthetic oligonucleotide
guaugguagaaacaacugccu

SEQ ID NO: 12017 - RNA, 21 nt, Artificial Sequence
  Synthetic oligonucleotide
uaugguagaaacaacugccua

SEQ ID NO: 12018 - RNA, 21 nt, Artificial Sequence
  Synthetic oligonucleotide
augguagaaacaacugccuau

SEQ ID NO: 12019 - RNA, 21 nt, Artificial Sequence
  Synthetic oligonucleotide
ugguagaaacaacugccuaug

SEQ ID NO: 12020 - RNA, 21 nt, Artificial Sequence
  Synthetic oligonucleotide
gguagaaacaacugccuaugc

SEQ ID NO: 12021 - RNA, 21 nt, Artificial Sequence
  Synthetic oligonucleotide
guagaaacaacugccuaugcu

SEQ ID NO: 12022 - RNA, 21 nt, Artificial Sequence
  Synthetic oligonucleotide
uagaaacaacugccuaugcuu

SEQ ID NO: 12023 - RNA, 21 nt, Artificial Sequence
  Synthetic oligonucleotide
agaaacaacugccuaugcuuu

SEQ ID NO: 12024 - RNA, 21 nt, Artificial Sequence
  Synthetic oligonucleotide
gaaacaacugccuaugcuuua

SEQ ID NO: 12025 - RNA, 21 nt, Artificial Sequence
  Synthetic oligonucleotide
aaacaacugccuaugcuuuac

SEQ ID NO: 12026 - RNA, 21 nt, Artificial Sequence
  Synthetic oligonucleotide
aacaacugccuaugcuuuacu

SEQ ID NO: 12027 - RNA, 21 nt, Artificial Sequence
  Synthetic oligonucleotide
acaacugccuaugcuuuacuc

SEQ ID NO: 12028 - RNA, 21 nt, Artificial Sequence
  Synthetic oligonucleotide
caacugccuaugcuuuacuca

SEQ ID NO: 12029 - RNA, 21 nt, Artificial Sequence
  Synthetic oligonucleotide
aacugccuaugcuuuacucac

SEQ ID NO: 12030 - RNA, 21 nt, Artificial Sequence
  Synthetic oligonucleotide
acugccuaugcuuuacucacc

SEQ ID NO: 12031 - RNA, 21 nt, Artificial Sequence
  Synthetic oligonucleotide
cugccuaugcuuuacucacca

SEQ ID NO: 12032 - RNA, 21 nt, Artificial Sequence
  Synthetic oligonucleotide
ugccuaugcuuuacucaccag

SEQ ID NO: 12033 - RNA, 21 nt, Artificial Sequence
  Synthetic oligonucleotide
gccuaugcuuuacucaccagu

SEQ ID NO: 12034 - RNA, 21 nt, Artificial Sequence
  Synthetic oligonucleotide
ccuaugcuuuacucaccaguc

SEQ ID NO: 12035 - RNA, 21 nt, Artificial Sequence
  Synthetic oligonucleotide
cuaugcuuuacucaccagucu

SEQ ID NO: 12036 - RNA, 21 nt, Artificial Sequence
  Synthetic oligonucleotide
uaugcuuuacucaccagucug

SEQ ID NO: 12037 - RNA, 21 nt, Artificial Sequence
  Synthetic oligonucleotide
gcuuuacucaccagucugaac

SEQ ID NO: 12038 - RNA, 21 nt, Artificial Sequence
  Synthetic oligonucleotide
cuuuacucaccagucugaacu

SEQ ID NO: 12039 - RNA, 21 nt, Artificial Sequence
  Synthetic oligonucleotide
uuuacucaccagucugaacuu

SEQ ID NO: 12040 - RNA, 21 nt, Artificial Sequence
  Synthetic oligonucleotide
uuacucaccagucugaacuug

SEQ ID NO: 12041 - RNA, 21 nt, Artificial Sequence
  Synthetic oligonucleotide
acucaccagucugaacuugaa

SEQ ID NO: 12042 - RNA, 21 nt, Artificial Sequence
  Synthetic oligonucleotide
cucaccagucugaacuugaaa

SEQ ID NO: 12043 - RNA, 21 nt, Artificial Sequence
  Synthetic oligonucleotide
ucaccagucugaacuugaaag

SEQ ID NO: 12044 - RNA, 21 nt, Artificial Sequence
  Synthetic oligonucleotide
agucaucaaauggcuaucaga

SEQ ID NO: 12045 - RNA, 21 nt, Artificial Sequence
  Synthetic oligonucleotide
gucaucaaauggcuaucagaa

SEQ ID NO: 12046 - RNA, 21 nt, Artificial Sequence
  Synthetic oligonucleotide
ucaucaaauggcuaucagaag

SEQ ID NO: 12047 - RNA, 21 nt, Artificial Sequence
  Synthetic oligonucleotide
caucaaauggcuaucagaaga

SEQ ID NO: 12048 - RNA, 21 nt, Artificial Sequence
  Synthetic oligonucleotide
aucaaauggcuaucagaagag

SEQ ID NO: 12049 - RNA, 21 nt, Artificial Sequence
  Synthetic oligonucleotide
ucaaauggcuaucagaagagc

SEQ ID NO: 12050 - RNA, 21 nt, Artificial Sequence
  Synthetic oligonucleotide
caaauggcuaucagaagagca

SEQ ID NO: 12051 - RNA, 21 nt, Artificial Sequence
  Synthetic oligonucleotide
aaauggcuaucagaagagcag

SEQ ID NO: 12052 - RNA, 21 nt, Artificial Sequence
  Synthetic oligonucleotide
aauggcuaucagaagagcaga

SEQ ID NO: 12053 - RNA, 21 nt, Artificial Sequence
  Synthetic oligonucleotide
auggcuaucagaagagcagag

SEQ ID NO: 12054 - RNA, 21 nt, Artificial Sequence
  Synthetic oligonucleotide
uggcuaucagaagagcagagg

SEQ ID NO: 12055 - RNA, 21 nt, Artificial Sequence
  Synthetic oligonucleotide
ggcuaucagaagagcagaggu

SEQ ID NO: 12056 - RNA, 21 nt, Artificial Sequence
  Synthetic oligonucleotide
gcuaucagaagagcagaggua

SEQ ID NO: 12057 - RNA, 21 nt, Artificial Sequence
  Synthetic oligonucleotide
cuaucagaagagcagagguau

SEQ ID NO: 12058 - RNA, 21 nt, Artificial Sequence
  Synthetic oligonucleotide
uaucagaagagcagagguaug

SEQ ID NO: 12059 - RNA, 21 nt, Artificial Sequence
  Synthetic oligonucleotide
aucagaagagcagagguaugg

SEQ ID NO: 12060 - RNA, 21 nt, Artificial Sequence
  Synthetic oligonucleotide
ucagaagagcagagguaugga

SEQ ID NO: 12061 - RNA, 21 nt, Artificial Sequence
  Synthetic oligonucleotide
gaagagcagagguauggaggu

SEQ ID NO: 12062 - RNA, 21 nt, Artificial Sequence
  Synthetic oligonucleotide
aagagcagagguauggaggug

SEQ ID NO: 12063 - RNA, 21 nt, Artificial Sequence
  Synthetic oligonucleotide
agagcagagguauggaggugg

SEQ ID NO: 12064 - RNA, 21 nt, Artificial Sequence
  Synthetic oligonucleotide
gagcagagguauggagguggc

SEQ ID NO: 12065 - RNA, 21 nt, Artificial Sequence
  Synthetic oligonucleotide
agcagagguauggagguggcu

SEQ ID NO: 12066 - RNA, 21 nt, Artificial Sequence
  Synthetic oligonucleotide
gcagagguauggagguggcuu

SEQ ID NO: 12067 - RNA, 21 nt, Artificial Sequence
  Synthetic oligonucleotide
cagagguauggagguggcuuu

SEQ ID NO: 12068 - RNA, 21 nt, Artificial Sequence
  Synthetic oligonucleotide
agagguauggagguggcuuuu

SEQ ID NO: 12069 - RNA, 21 nt, Artificial Sequence
  Synthetic oligonucleotide
gagguauggagguggcuuuua

SEQ ID NO: 12070 - RNA, 21 nt, Artificial Sequence
  Synthetic oligonucleotide
agguauggagguggcuuuuau

SEQ ID NO: 12071 - RNA, 21 nt, Artificial Sequence
  Synthetic oligonucleotide
gguauggagguggcuuuuauu

SEQ ID NO: 12072 - RNA, 21 nt, Artificial Sequence
  Synthetic oligonucleotide
guauggagguggcuuuuauuc

SEQ ID NO: 12073 - RNA, 21 nt, Artificial Sequence
  Synthetic oligonucleotide
uauggagguggcuuuuauuca

SEQ ID NO: 12074 - RNA, 21 nt, Artificial Sequence
  Synthetic oligonucleotide
auggagguggcuuuuauucaa

SEQ ID NO: 12075 - RNA, 21 nt, Artificial Sequence
  Synthetic oligonucleotide
uggagguggcuuuuauucaac

SEQ ID NO: 12076 - RNA, 21 nt, Artificial Sequence
  Synthetic oligonucleotide
ggagguggcuuuuauucaacc

SEQ ID NO: 12077 - RNA, 21 nt, Artificial Sequence
  Synthetic oligonucleotide
gagguggcuuuuauucaaccc

SEQ ID NO: 12078 - RNA, 21 nt, Artificial Sequence
  Synthetic oligonucleotide
agguggcuuuuauucaaccca

SEQ ID NO: 12079 - RNA, 21 nt, Artificial Sequence
  Synthetic oligonucleotide
ggaauauucacuccugguuaa

SEQ ID NO: 12080 - RNA, 21 nt, Artificial Sequence
  Synthetic oligonucleotide
gaauauucacuccugguuaaa

SEQ ID NO: 12081 - RNA, 21 nt, Artificial Sequence
  Synthetic oligonucleotide
aauauucacuccugguuaaac

SEQ ID NO: 12082 - RNA, 21 nt, Artificial Sequence
  Synthetic oligonucleotide
auauucacuccugguuaaaca

SEQ ID NO: 12083 - RNA, 21 nt, Artificial Sequence
  Synthetic oligonucleotide
gccuuacauaauuauaaaaug

SEQ ID NO: 12084 - RNA, 21 nt, Artificial Sequence
  Synthetic oligonucleotide
ccuuacauaauuauaaaauga

SEQ ID NO: 12085 - RNA, 21 nt, Artificial Sequence
  Synthetic oligonucleotide
cuuacauaauuauaaaaugac

SEQ ID NO: 12086 - RNA, 21 nt, Artificial Sequence
  Synthetic oligonucleotide
uuacauaauuauaaaaugaca

SEQ ID NO: 12087 - RNA, 21 nt, Artificial Sequence
  Synthetic oligonucleotide
uacauaauuauaaaaugacag

SEQ ID NO: 12088 - RNA, 21 nt, Artificial Sequence
  Synthetic oligonucleotide
acauaauuauaaaaugacaga

SEQ ID NO: 12089 - RNA, 21 nt, Artificial Sequence
  Synthetic oligonucleotide
cauaauuauaaaaugacagac

SEQ ID NO: 12090 - RNA, 21 nt, Artificial Sequence
  Synthetic oligonucleotide
auaauuauaaaaugacagaca

SEQ ID NO: 12091 - RNA, 21 nt, Artificial Sequence
  Synthetic oligonucleotide
uaauuauaaaaugacagacaa

SEQ ID NO: 12092 - RNA, 21 nt, Artificial Sequence
  Synthetic oligonucleotide
aauuauaaaaugacagacaag

SEQ ID NO: 12093 - RNA, 21 nt, Artificial Sequence
  Synthetic oligonucleotide
auuauaaaaugacagacaaga

SEQ ID NO: 12094 - RNA, 21 nt, Artificial Sequence
  Synthetic oligonucleotide
uuauaaaaugacagacaagaa

SEQ ID NO: 12095 - RNA, 21 nt, Artificial Sequence
  Synthetic oligonucleotide
uauaaaaugacagacaagaau

SEQ ID NO: 12096 - RNA, 21 nt, Artificial Sequence
  Synthetic oligonucleotide
auaaaaugacagacaagaauu

SEQ ID NO: 12097 - RNA, 21 nt, Artificial Sequence
  Synthetic oligonucleotide
uaaaaugacagacaagaauuu

SEQ ID NO: 12098 - RNA, 21 nt, Artificial Sequence
  Synthetic oligonucleotide
aaaaugacagacaagaauuuc

SEQ ID NO: 12099 - RNA, 21 nt, Artificial Sequence
  Synthetic oligonucleotide
aaaugacagacaagaauuucc

SEQ ID NO: 12100 - RNA, 21 nt, Artificial Sequence
  Synthetic oligonucleotide
aaugacagacaagaauuuccu

SEQ ID NO: 12101 - RNA, 21 nt, Artificial Sequence
  Synthetic oligonucleotide
augacagacaagaauuuccuu

SEQ ID NO: 12102 - RNA, 21 nt, Artificial Sequence
  Synthetic oligonucleotide
ugacagacaagaauuuccuug

SEQ ID NO: 12103 - RNA, 21 nt, Artificial Sequence
  Synthetic oligonucleotide
gacagacaagaauuuccuugg

SEQ ID NO: 12104 - RNA, 21 nt, Artificial Sequence
  Synthetic oligonucleotide
acagacaagaauuuccuuggg

SEQ ID NO: 12105 - RNA, 21 nt, Artificial Sequence
  Synthetic oligonucleotide
cagacaagaauuuccuuggga

SEQ ID NO: 12106 - RNA, 21 nt, Artificial Sequence
  Synthetic oligonucleotide
agacaagaauuuccuugggag

SEQ ID NO: 12107 - RNA, 21 nt, Artificial Sequence
  Synthetic oligonucleotide
gacaagaauuuccuugggagg

SEQ ID NO: 12108 - RNA, 21 nt, Artificial Sequence
  Synthetic oligonucleotide
acaagaauuuccuugggaggc

SEQ ID NO: 12109 - RNA, 21 nt, Artificial Sequence
  Synthetic oligonucleotide
caagaauuuccuugggaggcc

SEQ ID NO: 12110 - RNA, 21 nt, Artificial Sequence
  Synthetic oligonucleotide
aagaauuuccuugggaggcca

SEQ ID NO: 12111 - RNA, 21 nt, Artificial Sequence
  Synthetic oligonucleotide
uccuugggaggccaguagagg

SEQ ID NO: 12112 - RNA, 21 nt, Artificial Sequence
  Synthetic oligonucleotide
uugggaggccaguagaggugc

SEQ ID NO: 12113 - RNA, 21 nt, Artificial Sequence
  Synthetic oligonucleotide
ugggaggccaguagaggugcu

SEQ ID NO: 12114 - RNA, 21 nt, Artificial Sequence
  Synthetic oligonucleotide
gggaggccaguagaggugcuu

SEQ ID NO: 12115 - RNA, 21 nt, Artificial Sequence
  Synthetic oligonucleotide
ggaggccaguagaggugcuuc

SEQ ID NO: 12116 - RNA, 21 nt, Artificial Sequence
  Synthetic oligonucleotide
gaggccaguagaggugcuucu

SEQ ID NO: 12117 - RNA, 21 nt, Artificial Sequence
  Synthetic oligonucleotide
aggccaguagaggugcuucuc

SEQ ID NO: 12118 - RNA, 21 nt, Artificial Sequence
  Synthetic oligonucleotide
ggccaguagaggugcuucuca

SEQ ID NO: 12119 - RNA, 21 nt, Artificial Sequence
  Synthetic oligonucleotide
gccaguagaggugcuucucaa

SEQ ID NO: 12120 - RNA, 21 nt, Artificial Sequence
  Synthetic oligonucleotide
ccaguagaggugcuucucaau

SEQ ID NO: 12121 - RNA, 21 nt, Artificial Sequence
  Synthetic oligonucleotide
caguagaggugcuucucaaug

SEQ ID NO: 12122 - RNA, 21 nt, Artificial Sequence
  Synthetic oligonucleotide
aguagaggugcuucucaauga

SEQ ID NO: 12123 - RNA, 21 nt, Artificial Sequence
  Synthetic oligonucleotide
guagaggugcuucucaaugau

SEQ ID NO: 12124 - RNA, 21 nt, Artificial Sequence
  Synthetic oligonucleotide
uagaggugcuucucaaugaug

SEQ ID NO: 12125 - RNA, 21 nt, Artificial Sequence
  Synthetic oligonucleotide
agaggugcuucucaaugauga

SEQ ID NO: 12126 - RNA, 21 nt, Artificial Sequence
  Synthetic oligonucleotide
gaggugcuucucaaugaugac

SEQ ID NO: 12127 - RNA, 21 nt, Artificial Sequence
  Synthetic oligonucleotide
aggugcuucucaaugaugacc

SEQ ID NO: 12128 - RNA, 21 nt, Artificial Sequence
  Synthetic oligonucleotide
ggugcuucucaaugaugaccu

SEQ ID NO: 12129 - RNA, 21 nt, Artificial Sequence
  Synthetic oligonucleotide
gugcuucucaaugaugaccuc

SEQ ID NO: 12130 - RNA, 21 nt, Artificial Sequence
  Synthetic oligonucleotide
cauugucaguacaggauuugg

SEQ ID NO: 12131 - RNA, 21 nt, Artificial Sequence
  Synthetic oligonucleotide
auugucaguacaggauuuggc

SEQ ID NO: 12132 - RNA, 21 nt, Artificial Sequence
  Synthetic oligonucleotide
uugucaguacaggauuuggca

SEQ ID NO: 12133 - RNA, 21 nt, Artificial Sequence
  Synthetic oligonucleotide
ugucaguacaggauuuggcag

SEQ ID NO: 12134 - RNA, 21 nt, Artificial Sequence
  Synthetic oligonucleotide
gucaguacaggauuuggcagu

SEQ ID NO: 12135 - RNA, 21 nt, Artificial Sequence
  Synthetic oligonucleotide
ucaguacaggauuuggcagug

SEQ ID NO: 12136 - RNA, 21 nt, Artificial Sequence
  Synthetic oligonucleotide
caguacaggauuuggcagugg

SEQ ID NO: 12137 - RNA, 21 nt, Artificial Sequence
  Synthetic oligonucleotide
aguacaggauuuggcaguggc

SEQ ID NO: 12138 - RNA, 21 nt, Artificial Sequence
  Synthetic oligonucleotide
guacaggauuuggcaguggcu

SEQ ID NO: 12139 - RNA, 21 nt, Artificial Sequence
  Synthetic oligonucleotide
uacaggauuuggcaguggcuu

SEQ ID NO: 12140 - RNA, 21 nt, Artificial Sequence
  Synthetic oligonucleotide
acaggauuuggcaguggcuug

SEQ ID NO: 12141 - RNA, 21 nt, Artificial Sequence
  Synthetic oligonucleotide
aggauuuggcaguggcuuggc

SEQ ID NO: 12142 - RNA, 21 nt, Artificial Sequence
  Synthetic oligonucleotide
ggauuuggcaguggcuuggcu

SEQ ID NO: 12143 - RNA, 21 nt, Artificial Sequence
  Synthetic oligonucleotide
gauuuggcaguggcuuggcua

SEQ ID NO: 12144 - RNA, 21 nt, Artificial Sequence
  Synthetic oligonucleotide
auuuggcaguggcuuggcuac

SEQ ID NO: 12145 - RNA, 21 nt, Artificial Sequence
  Synthetic oligonucleotide
caguacauguaacaacuguag

SEQ ID NO: 12146 - RNA, 21 nt, Artificial Sequence
  Synthetic oligonucleotide
aguacauguaacaacuguagu

SEQ ID NO: 12147 - RNA, 21 nt, Artificial Sequence
  Synthetic oligonucleotide
guacauguaacaacuguaguu

SEQ ID NO: 12148 - RNA, 21 nt, Artificial Sequence
  Synthetic oligonucleotide
acauguaacaacuguaguuca

SEQ ID NO: 12149 - RNA, 21 nt, Artificial Sequence
  Synthetic oligonucleotide
cauguaacaacuguaguucac

SEQ ID NO: 12150 - RNA, 21 nt, Artificial Sequence
  Synthetic oligonucleotide
auguaacaacuguaguucaca

SEQ ID NO: 12151 - RNA, 21 nt, Artificial Sequence
  Synthetic oligonucleotide
uguaacaacuguaguucacaa

SEQ ID NO: 12152 - RNA, 21 nt, Artificial Sequence
  Synthetic oligonucleotide
guaacaacuguaguucacaaa

SEQ ID NO: 12153 - RNA, 21 nt, Artificial Sequence
  Synthetic oligonucleotide
uaacaacuguaguucacaaaa

SEQ ID NO: 12154 - RNA, 21 nt, Artificial Sequence
  Synthetic oligonucleotide
aacaacuguaguucacaaaac

SEQ ID NO: 12155 - RNA, 21 nt, Artificial Sequence
  Synthetic oligonucleotide
acaacuguaguucacaaaacc

SEQ ID NO: 12156 - RNA, 21 nt, Artificial Sequence
  Synthetic oligonucleotide
caacuguaguucacaaaacca

SEQ ID NO: 12157 - RNA, 21 nt, Artificial Sequence
  Synthetic oligonucleotide
aacuguaguucacaaaaccag

SEQ ID NO: 12158 - RNA, 21 nt, Artificial Sequence
  Synthetic oligonucleotide
acuguaguucacaaaaccagu

SEQ ID NO: 12159 - RNA, 21 nt, Artificial Sequence
  Synthetic oligonucleotide
cuguaguucacaaaaccagua

SEQ ID NO: 12160 - RNA, 21 nt, Artificial Sequence
  Synthetic oligonucleotide
uguaguucacaaaaccaguac

SEQ ID NO: 12161 - RNA, 21 nt, Artificial Sequence
  Synthetic oligonucleotide
guaguucacaaaaccaguacc

SEQ ID NO: 12162 - RNA, 21 nt, Artificial Sequence
  Synthetic oligonucleotide
uaguucacaaaaccaguaccu

SEQ ID NO: 12163 - RNA, 21 nt, Artificial Sequence
  Synthetic oligonucleotide
aguucacaaaaccaguaccuc

SEQ ID NO: 12164 - RNA, 21 nt, Artificial Sequence
  Synthetic oligonucleotide
guucacaaaaccaguaccucu

SEQ ID NO: 12165 - RNA, 21 nt, Artificial Sequence
  Synthetic oligonucleotide
uucacaaaaccaguaccucug

SEQ ID NO: 12166 - RNA, 21 nt, Artificial Sequence
  Synthetic oligonucleotide
ucacaaaaccaguaccucuga

SEQ ID NO: 12167 - RNA, 21 nt, Artificial Sequence
  Synthetic oligonucleotide
cacaaaaccaguaccucugag

SEQ ID NO: 12168 - RNA, 21 nt, Artificial Sequence
  Synthetic oligonucleotide
acaaaaccaguaccucugagg

SEQ ID NO: 12169 - RNA, 21 nt, Artificial Sequence
  Synthetic oligonucleotide
caaaaccaguaccucugagga

SEQ ID NO: 12170 - RNA, 21 nt, Artificial Sequence
  Synthetic oligonucleotide
aaaaccaguaccucugaggaa

SEQ ID NO: 12171 - RNA, 21 nt, Artificial Sequence
  Synthetic oligonucleotide
aaaccaguaccucugaggaag

SEQ ID NO: 12172 - RNA, 21 nt, Artificial Sequence
  Synthetic oligonucleotide
aaccaguaccucugaggaagu

SEQ ID NO: 12173 - RNA, 21 nt, Artificial Sequence
  Synthetic oligonucleotide
accaguaccucugaggaaguu

SEQ ID NO: 12174 - RNA, 21 nt, Artificial Sequence
  Synthetic oligonucleotide
ccaguaccucugaggaaguuu

SEQ ID NO: 12175 - RNA, 21 nt, Artificial Sequence
  Synthetic oligonucleotide
caguaccucugaggaaguuug

SEQ ID NO: 12176 - RNA, 21 nt, Artificial Sequence
  Synthetic oligonucleotide
aguaccucugaggaaguuugc

SEQ ID NO: 12177 - RNA, 21 nt, Artificial Sequence
  Synthetic oligonucleotide
guaccucugaggaaguuugca

SEQ ID NO: 12178 - RNA, 21 nt, Artificial Sequence
  Synthetic oligonucleotide
uaccucugaggaaguuugcag

SEQ ID NO: 12179 - RNA, 21 nt, Artificial Sequence
  Synthetic oligonucleotide
accucugaggaaguuugcagc

SEQ ID NO: 12180 - RNA, 21 nt, Artificial Sequence
  Synthetic oligonucleotide
ccucugaggaaguuugcagcu

SEQ ID NO: 12181 - RNA, 21 nt, Artificial Sequence
  Synthetic oligonucleotide
cucugaggaaguuugcagcuu

SEQ ID NO: 12182 - RNA, 21 nt, Artificial Sequence
  Synthetic oligonucleotide
ucugaggaaguuugcagcuuu

SEQ ID NO: 12183 - RNA, 21 nt, Artificial Sequence
  Synthetic oligonucleotide
guuugcagcuuuuauuugaaa

SEQ ID NO: 12184 - RNA, 21 nt, Artificial Sequence
  Synthetic oligonucleotide
uuugcagcuuuuauuugaaaa

SEQ ID NO: 12185 - RNA, 21 nt, Artificial Sequence
  Synthetic oligonucleotide
ucgauacucaggauauugaag

SEQ ID NO: 12186 - RNA, 21 nt, Artificial Sequence
  Synthetic oligonucleotide
gauacucaggauauugaagca

SEQ ID NO: 12187 - RNA, 21 nt, Artificial Sequence
  Synthetic oligonucleotide
auacucaggauauugaagcau

SEQ ID NO: 12188 - RNA, 21 nt, Artificial Sequence
  Synthetic oligonucleotide
uacucaggauauugaagcauc

SEQ ID NO: 12189 - RNA, 21 nt, Artificial Sequence
  Synthetic oligonucleotide
acucaggauauugaagcaucc

SEQ ID NO: 12190 - RNA, 21 nt, Artificial Sequence
  Synthetic oligonucleotide
ucaggauauugaagcauccca

SEQ ID NO: 12191 - RNA, 21 nt, Artificial Sequence
  Synthetic oligonucleotide
caggauauugaagcaucccac

SEQ ID NO: 12192 - RNA, 21 nt, Artificial Sequence
  Synthetic oligonucleotide
aggauauugaagcaucccacu

SEQ ID NO: 12193 - RNA, 21 nt, Artificial Sequence
  Synthetic oligonucleotide
ggauauugaagcaucccacua

SEQ ID NO: 12194 - RNA, 21 nt, Artificial Sequence
  Synthetic oligonucleotide
gauauugaagcaucccacuac

SEQ ID NO: 12195 - RNA, 21 nt, Artificial Sequence
  Synthetic oligonucleotide
auauugaagcaucccacuaca

SEQ ID NO: 12196 - RNA, 21 nt, Artificial Sequence
  Synthetic oligonucleotide
uauugaagcaucccacuacag

SEQ ID NO: 12197 - RNA, 21 nt, Artificial Sequence
  Synthetic oligonucleotide
auugaagcaucccacuacaga

SEQ ID NO: 12198 - RNA, 21 nt, Artificial Sequence
  Synthetic oligonucleotide
uugaagcaucccacuacagag

SEQ ID NO: 12199 - RNA, 21 nt, Artificial Sequence
  Synthetic oligonucleotide
ugaagcaucccacuacagagg

SEQ ID NO: 12200 - RNA, 21 nt, Artificial Sequence
  Synthetic oligonucleotide
gaagcaucccacuacagaggc

SEQ ID NO: 12201 - RNA, 21 nt, Artificial Sequence
  Synthetic oligonucleotide
aagcaucccacuacagaggcu

SEQ ID NO: 12202 - RNA, 21 nt, Artificial Sequence
  Synthetic oligonucleotide
agcaucccacuacagaggcua

SEQ ID NO: 12203 - RNA, 21 nt, Artificial Sequence
  Synthetic oligonucleotide
gcaucccacuacagaggcuac

SEQ ID NO: 12204 - RNA, 21 nt, Artificial Sequence
  Synthetic oligonucleotide
caucccacuacagaggcuacg

SEQ ID NO: 12205 - RNA, 21 nt, Artificial Sequence
  Synthetic oligonucleotide
aucccacuacagaggcuacgg

SEQ ID NO: 12206 - RNA, 21 nt, Artificial Sequence
  Synthetic oligonucleotide
ucccacuacagaggcuacgga

SEQ ID NO: 12207 - RNA, 21 nt, Artificial Sequence
  Synthetic oligonucleotide
cccacuacagaggcuacggaa

SEQ ID NO: 12208 - RNA, 21 nt, Artificial Sequence
  Synthetic oligonucleotide
ccacuacagaggcuacggaaa

SEQ ID NO: 12209 - RNA, 21 nt, Artificial Sequence
  Synthetic oligonucleotide
cacuacagaggcuacggaaac

SEQ ID NO: 12210 - RNA, 21 nt, Artificial Sequence
  Synthetic oligonucleotide
acuacagaggcuacggaaacu

SEQ ID NO: 12211 - RNA, 21 nt, Artificial Sequence
  Synthetic oligonucleotide
cuacagaggcuacggaaacuc

SEQ ID NO: 12212 - RNA, 21 nt, Artificial Sequence
  Synthetic oligonucleotide
uacagaggcuacggaaacucu

SEQ ID NO: 12213 - RNA, 21 nt, Artificial Sequence
  Synthetic oligonucleotide
acagaggcuacggaaacucug

SEQ ID NO: 12214 - RNA, 21 nt, Artificial Sequence
  Synthetic oligonucleotide
cagaggcuacggaaacucuga

SEQ ID NO: 12215 - RNA, 21 nt, Artificial Sequence
  Synthetic oligonucleotide
agaggcuacggaaacucugau

SEQ ID NO: 12216 - RNA, 21 nt, Artificial Sequence
  Synthetic oligonucleotide
gaggcuacggaaacucugauu

SEQ ID NO: 12217 - RNA, 21 nt, Artificial Sequence
  Synthetic oligonucleotide
aggcuacggaaacucugauua

SEQ ID NO: 12218 - RNA, 21 nt, Artificial Sequence
  Synthetic oligonucleotide
ggcuacggaaacucugauuac

SEQ ID NO: 12219 - RNA, 21 nt, Artificial Sequence
  Synthetic oligonucleotide
gcuacggaaacucugauuaca

SEQ ID NO: 12220 - RNA, 21 nt, Artificial Sequence
  Synthetic oligonucleotide
cuacggaaacucugauuacaa

SEQ ID NO: 12221 - RNA, 21 nt, Artificial Sequence
  Synthetic oligonucleotide
uacggaaacucugauuacaaa

SEQ ID NO: 12222 - RNA, 21 nt, Artificial Sequence
  Synthetic oligonucleotide
acggaaacucugauuacaaac

SEQ ID NO: 12223 - RNA, 21 nt, Artificial Sequence
  Synthetic oligonucleotide
cggaaacucugauuacaaacg

SEQ ID NO: 12224 - RNA, 21 nt, Artificial Sequence
  Synthetic oligonucleotide
ggaaacucugauuacaaacgc

SEQ ID NO: 12225 - RNA, 21 nt, Artificial Sequence
  Synthetic oligonucleotide
gaaacucugauuacaaacgca

SEQ ID NO: 12226 - RNA, 21 nt, Artificial Sequence
  Synthetic oligonucleotide
aaacucugauuacaaacgcau

SEQ ID NO: 12227 - RNA, 21 nt, Artificial Sequence
  Synthetic oligonucleotide
aacucugauuacaaacgcaua

SEQ ID NO: 12228 - RNA, 21 nt, Artificial Sequence
  Synthetic oligonucleotide
acucugauuacaaacgcauag

SEQ ID NO: 12229 - RNA, 21 nt, Artificial Sequence
  Synthetic oligonucleotide
cucugauuacaaacgcauagu

SEQ ID NO: 12230 - RNA, 21 nt, Artificial Sequence
  Synthetic oligonucleotide
ucugauuacaaacgcauagua

SEQ ID NO: 12231 - RNA, 21 nt, Artificial Sequence
  Synthetic oligonucleotide
cugauuacaaacgcauaguag

SEQ ID NO: 12232 - RNA, 21 nt, Artificial Sequence
  Synthetic oligonucleotide
ugauuacaaacgcauaguagc

SEQ ID NO: 12233 - RNA, 21 nt, Artificial Sequence
  Synthetic oligonucleotide
gauuacaaacgcauaguagca

SEQ ID NO: 12234 - RNA, 21 nt, Artificial Sequence
  Synthetic oligonucleotide
auuacaaacgcauaguagcau

SEQ ID NO: 12235 - RNA, 21 nt, Artificial Sequence
  Synthetic oligonucleotide
uuacaaacgcauaguagcaug

SEQ ID NO: 12236 - RNA, 21 nt, Artificial Sequence
  Synthetic oligonucleotide
uacaaacgcauaguagcaugu

SEQ ID NO: 12237 - RNA, 21 nt, Artificial Sequence
  Synthetic oligonucleotide
acaaacgcauaguagcaugug

SEQ ID NO: 12238 - RNA, 21 nt, Artificial Sequence
  Synthetic oligonucleotide
caaacgcauaguagcaugugc

SEQ ID NO: 12239 - RNA, 21 nt, Artificial Sequence
  Synthetic oligonucleotide
aaacgcauaguagcaugugcc

SEQ ID NO: 12240 - RNA, 21 nt, Artificial Sequence
  Synthetic oligonucleotide
aacgcauaguagcaugugcca

SEQ ID NO: 12241 - RNA, 21 nt, Artificial Sequence
  Synthetic oligonucleotide
acgcauaguagcaugugccag

SEQ ID NO: 12242 - RNA, 21 nt, Artificial Sequence
  Synthetic oligonucleotide
cgcauaguagcaugugccagc

SEQ ID NO: 12243 - RNA, 21 nt, Artificial Sequence
  Synthetic oligonucleotide
gcauaguagcaugugccagcu

SEQ ID NO: 12244 - RNA, 21 nt, Artificial Sequence
  Synthetic oligonucleotide
cauaguagcaugugccagcua

SEQ ID NO: 12245 - RNA, 21 nt, Artificial Sequence
  Synthetic oligonucleotide
auaguagcaugugccagcuac

SEQ ID NO: 12246 - RNA, 21 nt, Artificial Sequence
  Synthetic oligonucleotide
uaguagcaugugccagcuaca

SEQ ID NO: 12247 - RNA, 21 nt, Artificial Sequence
  Synthetic oligonucleotide
cggugauggacaucuccuugc

SEQ ID NO: 12248 - RNA, 21 nt, Artificial Sequence
  Synthetic oligonucleotide
ggugauggacaucuccuugcc

SEQ ID NO: 12249 - RNA, 21 nt, Artificial Sequence
  Synthetic oligonucleotide
gugauggacaucuccuugccu

SEQ ID NO: 12250 - RNA, 21 nt, Artificial Sequence
  Synthetic oligonucleotide
ugauggacaucuccuugccua

SEQ ID NO: 12251 - RNA, 21 nt, Artificial Sequence
  Synthetic oligonucleotide
gauggacaucuccuugccuac

SEQ ID NO: 12252 - RNA, 21 nt, Artificial Sequence
  Synthetic oligonucleotide
auggacaucuccuugccuacu

SEQ ID NO: 12253 - RNA, 21 nt, Artificial Sequence
  Synthetic oligonucleotide
uggacaucuccuugccuacug

SEQ ID NO: 12254 - RNA, 21 nt, Artificial Sequence
  Synthetic oligonucleotide
ggacaucuccuugccuacugg

SEQ ID NO: 12255 - RNA, 21 nt, Artificial Sequence
  Synthetic oligonucleotide
gacaucuccuugccuacugga

SEQ ID NO: 12256 - RNA, 21 nt, Artificial Sequence
  Synthetic oligonucleotide
acaucuccuugccuacuggaa

SEQ ID NO: 12257 - RNA, 21 nt, Artificial Sequence
  Synthetic oligonucleotide
caucuccuugccuacuggaau

SEQ ID NO: 12258 - RNA, 21 nt, Artificial Sequence
  Synthetic oligonucleotide
aucuccuugccuacuggaauc

SEQ ID NO: 12259 - RNA, 21 nt, Artificial Sequence
  Synthetic oligonucleotide
ucuccuugccuacuggaauca

SEQ ID NO: 12260 - RNA, 21 nt, Artificial Sequence
  Synthetic oligonucleotide
agugcaaaugaagaagacuua

SEQ ID NO: 12261 - RNA, 21 nt, Artificial Sequence
  Synthetic oligonucleotide
gugcaaaugaagaagacuuaa

SEQ ID NO: 12262 - RNA, 21 nt, Artificial Sequence
  Synthetic oligonucleotide
ugcaaaugaagaagacuuaaa

SEQ ID NO: 12263 - RNA, 21 nt, Artificial Sequence
  Synthetic oligonucleotide
gcaaaugaagaagacuuaaaa

SEQ ID NO: 12264 - RNA, 21 nt, Artificial Sequence
  Synthetic oligonucleotide
caaaugaagaagacuuaaaag

SEQ ID NO: 12265 - RNA, 21 nt, Artificial Sequence
  Synthetic oligonucleotide
aaaugaagaagacuuaaaagc

SEQ ID NO: 12266 - RNA, 21 nt, Artificial Sequence
  Synthetic oligonucleotide
cccuuguggaagggguggauc

SEQ ID NO: 12267 - RNA, 21 nt, Artificial Sequence
  Synthetic oligonucleotide
ccuuguggaagggguggauca

SEQ ID NO: 12268 - RNA, 21 nt, Artificial Sequence
  Synthetic oligonucleotide
aacuauucacugauuaccaaa

SEQ ID NO: 12269 - RNA, 21 nt, Artificial Sequence
  Synthetic oligonucleotide
acuauucacugauuaccaaau

SEQ ID NO: 12270 - RNA, 21 nt, Artificial Sequence
  Synthetic oligonucleotide
ucaaagauggacauguuauuc

SEQ ID NO: 12271 - RNA, 21 nt, Artificial Sequence
  Synthetic oligonucleotide
caaagauggacauguuauucu

SEQ ID NO: 12272 - RNA, 21 nt, Artificial Sequence
  Synthetic oligonucleotide
aaagauggacauguuauucug

SEQ ID NO: 12273 - RNA, 21 nt, Artificial Sequence
  Synthetic oligonucleotide
gauggacauguuauucugcaa

SEQ ID NO: 12274 - RNA, 21 nt, Artificial Sequence
  Synthetic oligonucleotide
uggacauguuauucugcaacu

SEQ ID NO: 12275 - RNA, 21 nt, Artificial Sequence
  Synthetic oligonucleotide
cauguuauucugcaacugaau

SEQ ID NO: 12276 - RNA, 21 nt, Artificial Sequence
  Synthetic oligonucleotide
auguuauucugcaacugaauu

SEQ ID NO: 12277 - RNA, 21 nt, Artificial Sequence
  Synthetic oligonucleotide
uguuauucugcaacugaauuc

SEQ ID NO: 12278 - RNA, 21 nt, Artificial Sequence
  Synthetic oligonucleotide
guuauucugcaacugaauucg

SEQ ID NO: 12279 - RNA, 21 nt, Artificial Sequence
  Synthetic oligonucleotide
uauuugaacucuuugaaguug

SEQ ID NO: 12280 - RNA, 21 nt, Artificial Sequence
  Synthetic oligonucleotide
auuugaacucuuugaaguugg

SEQ ID NO: 12281 - RNA, 21 nt, Artificial Sequence
  Synthetic oligonucleotide
uuugaacucuuugaaguuggg

SEQ ID NO: 12282 - RNA, 21 nt, Artificial Sequence
  Synthetic oligonucleotide
uugaacucuuugaaguugggu

SEQ ID NO: 12283 - RNA, 21 nt, Artificial Sequence
  Synthetic oligonucleotide
ugaacucuuugaaguuggguu

SEQ ID NO: 12284 - RNA, 21 nt, Artificial Sequence
  Synthetic oligonucleotide
gaacucuuugaaguuggguuu

SEQ ID NO: 12285 - RNA, 21 nt, Artificial Sequence
  Synthetic oligonucleotide
aacucuuugaaguuggguuuc

SEQ ID NO: 12286 - RNA, 21 nt, Artificial Sequence
  Synthetic oligonucleotide
acucuuugaaguuggguuucu

SEQ ID NO: 12287 - RNA, 21 nt, Artificial Sequence
  Synthetic oligonucleotide
ucaguccugccacuuucacag

SEQ ID NO: 12288 - RNA, 21 nt, Artificial Sequence
  Synthetic oligonucleotide
caguccugccacuuucacagu

SEQ ID NO: 12289 - RNA, 21 nt, Artificial Sequence
  Synthetic oligonucleotide
aguccugccacuuucacagug

SEQ ID NO: 12290 - RNA, 21 nt, Artificial Sequence
  Synthetic oligonucleotide
guccugccacuuucacagugu

SEQ ID NO: 12291 - RNA, 21 nt, Artificial Sequence
  Synthetic oligonucleotide
uccugccacuuucacagugua

SEQ ID NO: 12292 - RNA, 21 nt, Artificial Sequence
  Synthetic oligonucleotide
acgaauaccacagaccagaua

SEQ ID NO: 12293 - RNA, 21 nt, Artificial Sequence
  Synthetic oligonucleotide
cgaauaccacagaccagauaa

SEQ ID NO: 12294 - RNA, 21 nt, Artificial Sequence
  Synthetic oligonucleotide
gaauaccacagaccagauaaa

SEQ ID NO: 12295 - RNA, 21 nt, Artificial Sequence
  Synthetic oligonucleotide
aauaccacagaccagauaaac

SEQ ID NO: 12296 - RNA, 21 nt, Artificial Sequence
  Synthetic oligonucleotide
auaccacagaccagauaaaca

SEQ ID NO: 12297 - RNA, 21 nt, Artificial Sequence
  Synthetic oligonucleotide
uaccacagaccagauaaacag

SEQ ID NO: 12298 - RNA, 21 nt, Artificial Sequence
  Synthetic oligonucleotide
accacagaccagauaaacagu

SEQ ID NO: 12299 - RNA, 21 nt, Artificial Sequence
  Synthetic oligonucleotide
ccacagaccagauaaacagug

SEQ ID NO: 12300 - RNA, 21 nt, Artificial Sequence
  Synthetic oligonucleotide
cacagaccagauaaacagugu

SEQ ID NO: 12301 - RNA, 21 nt, Artificial Sequence
  Synthetic oligonucleotide
acagaccagauaaacagugua

SEQ ID NO: 12302 - RNA, 21 nt, Artificial Sequence
  Synthetic oligonucleotide
cagaccagauaaacaguguac

SEQ ID NO: 12303 - RNA, 21 nt, Artificial Sequence
  Synthetic oligonucleotide
agaccagauaaacaguguacc

SEQ ID NO: 12304 - RNA, 21 nt, Artificial Sequence
  Synthetic oligonucleotide
gaccagauaaacaguguacca

SEQ ID NO: 12305 - RNA, 21 nt, Artificial Sequence
  Synthetic oligonucleotide
accagauaaacaguguaccau

SEQ ID NO: 12306 - RNA, 21 nt, Artificial Sequence
  Synthetic oligonucleotide
ccagauaaacaguguaccaug

SEQ ID NO: 12307 - RNA, 21 nt, Artificial Sequence
  Synthetic oligonucleotide
gauaaacaguguaccauguuu

SEQ ID NO: 12308 - RNA, 21 nt, Artificial Sequence
  Synthetic oligonucleotide
uaaacaguguaccauguuuua

SEQ ID NO: 12309 - RNA, 21 nt, Artificial Sequence
  Synthetic oligonucleotide
aacaguguaccauguuuuaua

SEQ ID NO: 12310 - RNA, 21 nt, Artificial Sequence
  Synthetic oligonucleotide
acaguguaccauguuuuauag

SEQ ID NO: 12311 - RNA, 21 nt, Artificial Sequence
  Synthetic oligonucleotide
caguguaccauguuuuauagc

SEQ ID NO: 12312 - RNA, 21 nt, Artificial Sequence
  Synthetic oligonucleotide
aguguaccauguuuuauagca

SEQ ID NO: 12313 - RNA, 21 nt, Artificial Sequence
  Synthetic oligonucleotide
guguaccauguuuuauagcac

SEQ ID NO: 12314 - RNA, 21 nt, Artificial Sequence
  Synthetic oligonucleotide
uguaccauguuuuauagcacu

SEQ ID NO: 12315 - RNA, 21 nt, Artificial Sequence
  Synthetic oligonucleotide
guaccauguuuuauagcacuu

SEQ ID NO: 12316 - RNA, 21 nt, Artificial Sequence
  Synthetic oligonucleotide
uaccauguuuuauagcacuuc

SEQ ID NO: 12317 - RNA, 21 nt, Artificial Sequence
  Synthetic oligonucleotide
accauguuuuauagcacuucc

SEQ ID NO: 12318 - RNA, 21 nt, Artificial Sequence
  Synthetic oligonucleotide
ccauguuuuauagcacuucca

SEQ ID NO: 12319 - RNA, 21 nt, Artificial Sequence
  Synthetic oligonucleotide
cauguuuuauagcacuuccaa

SEQ ID NO: 12320 - RNA, 21 nt, Artificial Sequence
  Synthetic oligonucleotide
auguuuuauagcacuuccaau

SEQ ID NO: 12321 - RNA, 21 nt, Artificial Sequence
  Synthetic oligonucleotide
uguuuuauagcacuuccaaua

SEQ ID NO: 12322 - RNA, 21 nt, Artificial Sequence
  Synthetic oligonucleotide
guuuuauagcacuuccaauau

SEQ ID NO: 12323 - RNA, 21 nt, Artificial Sequence
  Synthetic oligonucleotide
uuuuauagcacuuccaauauc

SEQ ID NO: 12324 - RNA, 21 nt, Artificial Sequence
  Synthetic oligonucleotide
uuuauagcacuuccaauauca

SEQ ID NO: 12325 - RNA, 21 nt, Artificial Sequence
  Synthetic oligonucleotide
uauagcacuuccaauaucaaa

SEQ ID NO: 12326 - RNA, 21 nt, Artificial Sequence
  Synthetic oligonucleotide
auagcacuuccaauaucaaaa

SEQ ID NO: 12327 - RNA, 21 nt, Artificial Sequence
  Synthetic oligonucleotide
uagcacuuccaauaucaaaau

SEQ ID NO: 12328 - RNA, 21 nt, Artificial Sequence
  Synthetic oligonucleotide
agcacuuccaauaucaaaauu

SEQ ID NO: 12329 - RNA, 21 nt, Artificial Sequence
  Synthetic oligonucleotide
gcacuuccaauaucaaaauuc

SEQ ID NO: 12330 - RNA, 21 nt, Artificial Sequence
  Synthetic oligonucleotide
cacuuccaauaucaaaauuca

SEQ ID NO: 12331 - RNA, 21 nt, Artificial Sequence
  Synthetic oligonucleotide
acuuccaauaucaaaauucag

SEQ ID NO: 12332 - RNA, 21 nt, Artificial Sequence
  Synthetic oligonucleotide
cuuccaauaucaaaauucaga

SEQ ID NO: 12333 - RNA, 21 nt, Artificial Sequence
  Synthetic oligonucleotide
uuccaauaucaaaauucagaa

SEQ ID NO: 12334 - RNA, 21 nt, Artificial Sequence
  Synthetic oligonucleotide
uccaauaucaaaauucagaaa

SEQ ID NO: 12335 - RNA, 21 nt, Artificial Sequence
  Synthetic oligonucleotide
ccaauaucaaaauucagaaag

SEQ ID NO: 12336 - RNA, 21 nt, Artificial Sequence
  Synthetic oligonucleotide
caauaucaaaauucagaaagu

SEQ ID NO: 12337 - RNA, 21 nt, Artificial Sequence
  Synthetic oligonucleotide
aauaucaaaauucagaaaguc

SEQ ID NO: 12338 - RNA, 21 nt, Artificial Sequence
  Synthetic oligonucleotide
auaucaaaauucagaaagucu

SEQ ID NO: 12339 - RNA, 21 nt, Artificial Sequence
  Synthetic oligonucleotide
uaucaaaauucagaaagucug

SEQ ID NO: 12340 - RNA, 21 nt, Artificial Sequence
  Synthetic oligonucleotide
aucaaaauucagaaagucugu

SEQ ID NO: 12341 - RNA, 21 nt, Artificial Sequence
  Synthetic oligonucleotide
ucaaaauucagaaagucugug

SEQ ID NO: 12342 - RNA, 21 nt, Artificial Sequence
  Synthetic oligonucleotide
caaaauucagaaagucuguga

SEQ ID NO: 12343 - RNA, 21 nt, Artificial Sequence
  Synthetic oligonucleotide
aaaauucagaaagucugugaa

SEQ ID NO: 12344 - RNA, 21 nt, Artificial Sequence
  Synthetic oligonucleotide
aaauucagaaagucugugaag

SEQ ID NO: 12345 - RNA, 21 nt, Artificial Sequence
  Synthetic oligonucleotide
cagaaagucugugaaggagcc

SEQ ID NO: 12346 - RNA, 21 nt, Artificial Sequence
  Synthetic oligonucleotide
uguagaagcugauugugggca

SEQ ID NO: 12347 - RNA, 21 nt, Artificial Sequence
  Synthetic oligonucleotide
guagaagcugauugugggcaa

SEQ ID NO: 12348 - RNA, 21 nt, Artificial Sequence
  Synthetic oligonucleotide
uagaagcugauugugggcaaa

SEQ ID NO: 12349 - RNA, 21 nt, Artificial Sequence
  Synthetic oligonucleotide
agaagcugauugugggcaaau

SEQ ID NO: 12350 - RNA, 21 nt, Artificial Sequence
  Synthetic oligonucleotide
gaagcugauugugggcaaaug

SEQ ID NO: 12351 - RNA, 21 nt, Artificial Sequence
  Synthetic oligonucleotide
aagcugauugugggcaaaugc

SEQ ID NO: 12352 - RNA, 21 nt, Artificial Sequence
  Synthetic oligonucleotide
agcugauugugggcaaaugca

SEQ ID NO: 12353 - RNA, 21 nt, Artificial Sequence
  Synthetic oligonucleotide
gcugauugugggcaaaugcag

SEQ ID NO: 12354 - RNA, 21 nt, Artificial Sequence
  Synthetic oligonucleotide
ggaagaauuggaucugacaau

SEQ ID NO: 12355 - RNA, 21 nt, Artificial Sequence
  Synthetic oligonucleotide
gaagaauuggaucugacaauc

SEQ ID NO: 12356 - RNA, 21 nt, Artificial Sequence
  Synthetic oligonucleotide
aagaauuggaucugacaaucu

SEQ ID NO: 12357 - RNA, 21 nt, Artificial Sequence
  Synthetic oligonucleotide
agaauuggaucugacaaucuc

SEQ ID NO: 12358 - RNA, 21 nt, Artificial Sequence
  Synthetic oligonucleotide
gaauuggaucugacaaucucu

SEQ ID NO: 12359 - RNA, 21 nt, Artificial Sequence
  Synthetic oligonucleotide
aauuggaucugacaaucucug

SEQ ID NO: 12360 - RNA, 21 nt, Artificial Sequence
  Synthetic oligonucleotide
auuggaucugacaaucucugc

SEQ ID NO: 12361 - RNA, 21 nt, Artificial Sequence
  Synthetic oligonucleotide
uuggaucugacaaucucugca

SEQ ID NO: 12362 - RNA, 21 nt, Artificial Sequence
  Synthetic oligonucleotide
uggaucugacaaucucugcag

SEQ ID NO: 12363 - RNA, 21 nt, Artificial Sequence
  Synthetic oligonucleotide
ggaucugacaaucucugcaga

SEQ ID NO: 12364 - RNA, 21 nt, Artificial Sequence
  Synthetic oligonucleotide
gaucugacaaucucugcagag

SEQ ID NO: 12365 - RNA, 21 nt, Artificial Sequence
  Synthetic oligonucleotide
aucugacaaucucugcagaga

SEQ ID NO: 12366 - RNA, 21 nt, Artificial Sequence
  Synthetic oligonucleotide
ucugacaaucucugcagagac

SEQ ID NO: 12367 - RNA, 21 nt, Artificial Sequence
  Synthetic oligonucleotide
caagaaaacaaacagcaugua

SEQ ID NO: 12368 - RNA, 21 nt, Artificial Sequence
  Synthetic oligonucleotide
aagaaaacaaacagcauguaa

SEQ ID NO: 12369 - RNA, 21 nt, Artificial Sequence
  Synthetic oligonucleotide
gagauugcauaugcuuauaaa

SEQ ID NO: 12370 - RNA, 21 nt, Artificial Sequence
  Synthetic oligonucleotide
agauugcauaugcuuauaaag

SEQ ID NO: 12371 - RNA, 21 nt, Artificial Sequence
  Synthetic oligonucleotide
gauugcauaugcuuauaaagu

SEQ ID NO: 12372 - RNA, 21 nt, Artificial Sequence
  Synthetic oligonucleotide
auugcauaugcuuauaaaguu

SEQ ID NO: 12373 - RNA, 21 nt, Artificial Sequence
  Synthetic oligonucleotide
uugcauaugcuuauaaaguua

SEQ ID NO: 12374 - RNA, 21 nt, Artificial Sequence
  Synthetic oligonucleotide
aaauguuuuugucaaguacaa

SEQ ID NO: 12375 - RNA, 21 nt, Artificial Sequence
  Synthetic oligonucleotide
aauguuuuugucaaguacaag

SEQ ID NO: 12376 - RNA, 21 nt, Artificial Sequence
  Synthetic oligonucleotide
auguuuuugucaaguacaagg

SEQ ID NO: 12377 - RNA, 21 nt, Artificial Sequence
  Synthetic oligonucleotide
uguuuuugucaaguacaaggc

SEQ ID NO: 12378 - RNA, 21 nt, Artificial Sequence
  Synthetic oligonucleotide
guuuuugucaaguacaaggca

SEQ ID NO: 12379 - RNA, 21 nt, Artificial Sequence
  Synthetic oligonucleotide
uuuuugucaaguacaaggcaa

SEQ ID NO: 12380 - RNA, 21 nt, Artificial Sequence
  Synthetic oligonucleotide
uuuugucaaguacaaggcaac

SEQ ID NO: 12381 - RNA, 21 nt, Artificial Sequence
  Synthetic oligonucleotide
uuugucaaguacaaggcaacc

SEQ ID NO: 12382 - RNA, 21 nt, Artificial Sequence
  Synthetic oligonucleotide
uugucaaguacaaggcaaccc

SEQ ID NO: 12383 - RNA, 21 nt, Artificial Sequence
  Synthetic oligonucleotide
ugucaaguacaaggcaacccu

SEQ ID NO: 12384 - RNA, 21 nt, Artificial Sequence
  Synthetic oligonucleotide
gucaaguacaaggcaacccuu

SEQ ID NO: 12385 - RNA, 21 nt, Artificial Sequence
  Synthetic oligonucleotide
ucaaguacaaggcaacccuuc

SEQ ID NO: 12386 - RNA, 21 nt, Artificial Sequence
  Synthetic oligonucleotide
caaguacaaggcaacccuucu

SEQ ID NO: 12387 - RNA, 21 nt, Artificial Sequence
  Synthetic oligonucleotide
aaguacaaggcaacccuucug

SEQ ID NO: 12388 - RNA, 21 nt, Artificial Sequence
  Synthetic oligonucleotide
aguacaaggcaacccuucugg

SEQ ID NO: 12389 - RNA, 21 nt, Artificial Sequence
  Synthetic oligonucleotide
guacaaggcaacccuucugga

SEQ ID NO: 12390 - RNA, 21 nt, Artificial Sequence
  Synthetic oligonucleotide
uacaaggcaacccuucuggau

SEQ ID NO: 12391 - RNA, 21 nt, Artificial Sequence
  Synthetic oligonucleotide
acaaggcaacccuucuggaua

SEQ ID NO: 12392 - RNA, 21 nt, Artificial Sequence
  Synthetic oligonucleotide
caaggcaacccuucuggauau

SEQ ID NO: 12393 - RNA, 21 nt, Artificial Sequence
  Synthetic oligonucleotide
aaggcaacccuucuggauauc

SEQ ID NO: 12394 - RNA, 21 nt, Artificial Sequence
  Synthetic oligonucleotide
aggcaacccuucuggauaucu

SEQ ID NO: 12395 - RNA, 21 nt, Artificial Sequence
  Synthetic oligonucleotide
ggcaacccuucuggauaucua

SEQ ID NO: 12396 - RNA, 21 nt, Artificial Sequence
  Synthetic oligonucleotide
gcaacccuucuggauaucuac

SEQ ID NO: 12397 - RNA, 21 nt, Artificial Sequence
  Synthetic oligonucleotide
caacccuucuggauaucuaca

SEQ ID NO: 12398 - RNA, 21 nt, Artificial Sequence
  Synthetic oligonucleotide
aacccuucuggauaucuacaa

SEQ ID NO: 12399 - RNA, 21 nt, Artificial Sequence
  Synthetic oligonucleotide
acccuucuggauaucuacaaa

SEQ ID NO: 12400 - RNA, 21 nt, Artificial Sequence
  Synthetic oligonucleotide
cccuucuggauaucuacaaaa

SEQ ID NO: 12401 - RNA, 21 nt, Artificial Sequence
  Synthetic oligonucleotide
ccuucuggauaucuacaaaac

SEQ ID NO: 12402 - RNA, 21 nt, Artificial Sequence
  Synthetic oligonucleotide
cuucuggauaucuacaaaacu

SEQ ID NO: 12403 - RNA, 21 nt, Artificial Sequence
  Synthetic oligonucleotide
uucuggauaucuacaaaacug

SEQ ID NO: 12404 - RNA, 21 nt, Artificial Sequence
  Synthetic oligonucleotide
ucuggauaucuacaaaacugg

SEQ ID NO: 12405 - RNA, 21 nt, Artificial Sequence
  Synthetic oligonucleotide
cuggauaucuacaaaacuggg

SEQ ID NO: 12406 - RNA, 21 nt, Artificial Sequence
  Synthetic oligonucleotide
uggauaucuacaaaacugggg

SEQ ID NO: 12407 - RNA, 21 nt, Artificial Sequence
  Synthetic oligonucleotide
ggauaucuacaaaacugggga

SEQ ID NO: 12408 - RNA, 21 nt, Artificial Sequence
  Synthetic oligonucleotide
gauaucuacaaaacuggggaa

SEQ ID NO: 12409 - RNA, 21 nt, Artificial Sequence
  Synthetic oligonucleotide
auaucuacaaaacuggggaag

SEQ ID NO: 12410 - RNA, 21 nt, Artificial Sequence
  Synthetic oligonucleotide
uaucuacaaaacuggggaagc

SEQ ID NO: 12411 - RNA, 21 nt, Artificial Sequence
  Synthetic oligonucleotide
aucuacaaaacuggggaagcu

SEQ ID NO: 12412 - RNA, 21 nt, Artificial Sequence
  Synthetic oligonucleotide
ucuacaaaacuggggaagcug

SEQ ID NO: 12413 - RNA, 21 nt, Artificial Sequence
  Synthetic oligonucleotide
cuacaaaacuggggaagcugu

SEQ ID NO: 12414 - RNA, 21 nt, Artificial Sequence
  Synthetic oligonucleotide
uacaaaacuggggaagcuguu

SEQ ID NO: 12415 - RNA, 21 nt, Artificial Sequence
  Synthetic oligonucleotide
acaaaacuggggaagcuguug

SEQ ID NO: 12416 - RNA, 21 nt, Artificial Sequence
  Synthetic oligonucleotide
caaaacuggggaagcuguugc

SEQ ID NO: 12417 - RNA, 21 nt, Artificial Sequence
  Synthetic oligonucleotide
aaaacuggggaagcuguugcu

SEQ ID NO: 12418 - RNA, 21 nt, Artificial Sequence
  Synthetic oligonucleotide
aaacuggggaagcuguugcug

SEQ ID NO: 12419 - RNA, 21 nt, Artificial Sequence
  Synthetic oligonucleotide
aacuggggaagcuguugcuga

SEQ ID NO: 12420 - RNA, 21 nt, Artificial Sequence
  Synthetic oligonucleotide
uuaccuucauuaaaaagguaa

SEQ ID NO: 12421 - RNA, 21 nt, Artificial Sequence
  Synthetic oligonucleotide
uaccuucauuaaaaagguaac

SEQ ID NO: 12422 - RNA, 21 nt, Artificial Sequence
  Synthetic oligonucleotide
accuucauuaaaaagguaacc

SEQ ID NO: 12423 - RNA, 21 nt, Artificial Sequence
  Synthetic oligonucleotide
ccuucauuaaaaagguaaccu

SEQ ID NO: 12424 - RNA, 21 nt, Artificial Sequence
  Synthetic oligonucleotide
cuucauuaaaaagguaaccug

SEQ ID NO: 12425 - RNA, 21 nt, Artificial Sequence
  Synthetic oligonucleotide
uaaaaggaagacaguacuuaa

SEQ ID NO: 12426 - RNA, 21 nt, Artificial Sequence
  Synthetic oligonucleotide
aaaaggaagacaguacuuaau

SEQ ID NO: 12427 - RNA, 21 nt, Artificial Sequence
  Synthetic oligonucleotide
aaaggaagacaguacuuaauu

SEQ ID NO: 12428 - RNA, 21 nt, Artificial Sequence
  Synthetic oligonucleotide
aaggaagacaguacuuaauua

SEQ ID NO: 12429 - RNA, 21 nt, Artificial Sequence
  Synthetic oligonucleotide
aggaagacaguacuuaauuau

SEQ ID NO: 12430 - RNA, 21 nt, Artificial Sequence
  Synthetic oligonucleotide
ggaagacaguacuuaauuaug

SEQ ID NO: 12431 - RNA, 21 nt, Artificial Sequence
  Synthetic oligonucleotide
gaagacaguacuuaauuaugg

SEQ ID NO: 12432 - RNA, 21 nt, Artificial Sequence
  Synthetic oligonucleotide
aagacaguacuuaauuauggg

SEQ ID NO: 12433 - RNA, 21 nt, Artificial Sequence
  Synthetic oligonucleotide
cccuccagauaaaauacaauu

SEQ ID NO: 12434 - RNA, 21 nt, Artificial Sequence
  Synthetic oligonucleotide
ccuccagauaaaauacaauuu

SEQ ID NO: 12435 - RNA, 21 nt, Artificial Sequence
  Synthetic oligonucleotide
uccagauaaaauacaauuuca

SEQ ID NO: 12436 - RNA, 21 nt, Artificial Sequence
  Synthetic oligonucleotide
aguuucagguacaucuacccu

SEQ ID NO: 12437 - RNA, 21 nt, Artificial Sequence
  Synthetic oligonucleotide
guuucagguacaucuacccuu

SEQ ID NO: 12438 - RNA, 21 nt, Artificial Sequence
  Synthetic oligonucleotide
uuucagguacaucuacccuuu

SEQ ID NO: 12439 - RNA, 21 nt, Artificial Sequence
  Synthetic oligonucleotide
uucagguacaucuacccuuua

SEQ ID NO: 12440 - RNA, 21 nt, Artificial Sequence
  Synthetic oligonucleotide
ucagguacaucuacccuuuag

SEQ ID NO: 12441 - RNA, 21 nt, Artificial Sequence
  Synthetic oligonucleotide
cagguacaucuacccuuuaga

SEQ ID NO: 12442 - RNA, 21 nt, Artificial Sequence
  Synthetic oligonucleotide
agguacaucuacccuuuagau

SEQ ID NO: 12443 - RNA, 21 nt, Artificial Sequence
  Synthetic oligonucleotide
gguacaucuacccuuuagauu

SEQ ID NO: 12444 - RNA, 21 nt, Artificial Sequence
  Synthetic oligonucleotide
guacaucuacccuuuagauuc

SEQ ID NO: 12445 - RNA, 21 nt, Artificial Sequence
  Synthetic oligonucleotide
uacaucuacccuuuagauucc

SEQ ID NO: 12446 - RNA, 21 nt, Artificial Sequence
  Synthetic oligonucleotide
acaucuacccuuuagauuccu

SEQ ID NO: 12447 - RNA, 21 nt, Artificial Sequence
  Synthetic oligonucleotide
caucuacccuuuagauuccuu

SEQ ID NO: 12448 - RNA, 21 nt, Artificial Sequence
  Synthetic oligonucleotide
aucuacccuuuagauuccuug

SEQ ID NO: 12449 - RNA, 21 nt, Artificial Sequence
  Synthetic oligonucleotide
ucuacccuuuagauuccuuga

SEQ ID NO: 12450 - RNA, 21 nt, Artificial Sequence
  Synthetic oligonucleotide
cuacccuuuagauuccuugac

SEQ ID NO: 12451 - RNA, 21 nt, Artificial Sequence
  Synthetic oligonucleotide
uacccuuuagauuccuugacc

SEQ ID NO: 12452 - RNA, 21 nt, Artificial Sequence
  Synthetic oligonucleotide
acccuuuagauuccuugaccu

SEQ ID NO: 12453 - RNA, 21 nt, Artificial Sequence
  Synthetic oligonucleotide
cccuuuagauuccuugaccug

SEQ ID NO: 12454 - RNA, 21 nt, Artificial Sequence
  Synthetic oligonucleotide
ccuuuagauuccuugaccugg

SEQ ID NO: 12455 - RNA, 21 nt, Artificial Sequence
  Synthetic oligonucleotide
cuuuagauuccuugaccugga

SEQ ID NO: 12456 - RNA, 21 nt, Artificial Sequence
  Synthetic oligonucleotide
uuuagauuccuugaccuggau

SEQ ID NO: 12457 - RNA, 21 nt, Artificial Sequence
  Synthetic oligonucleotide
uuagauuccuugaccuggauu

SEQ ID NO: 12458 - RNA, 21 nt, Artificial Sequence
  Synthetic oligonucleotide
uagauuccuugaccuggauug

SEQ ID NO: 12459 - RNA, 21 nt, Artificial Sequence
  Synthetic oligonucleotide
agauuccuugaccuggauuga

SEQ ID NO: 12460 - RNA, 21 nt, Artificial Sequence
  Synthetic oligonucleotide
gauuccuugaccuggauugaa

SEQ ID NO: 12461 - RNA, 21 nt, Artificial Sequence
  Synthetic oligonucleotide
auuccuugaccuggauugaau

SEQ ID NO: 12462 - RNA, 21 nt, Artificial Sequence
  Synthetic oligonucleotide
uuccuugaccuggauugaaua

SEQ ID NO: 12463 - RNA, 21 nt, Artificial Sequence
  Synthetic oligonucleotide
uccuugaccuggauugaauac

SEQ ID NO: 12464 - RNA, 21 nt, Artificial Sequence
  Synthetic oligonucleotide
ccuugaccuggauugaauacu

SEQ ID NO: 12465 - RNA, 21 nt, Artificial Sequence
  Synthetic oligonucleotide
cuugaccuggauugaauacug

SEQ ID NO: 12466 - RNA, 21 nt, Artificial Sequence
  Synthetic oligonucleotide
uugaccuggauugaauacugg

SEQ ID NO: 12467 - RNA, 21 nt, Artificial Sequence
  Synthetic oligonucleotide
ugaccuggauugaauacuggc

SEQ ID NO: 12468 - RNA, 21 nt, Artificial Sequence
  Synthetic oligonucleotide
gaccuggauugaauacuggcc

SEQ ID NO: 12469 - RNA, 21 nt, Artificial Sequence
  Synthetic oligonucleotide
accuggauugaauacuggccu

SEQ ID NO: 12470 - RNA, 21 nt, Artificial Sequence
  Synthetic oligonucleotide
ccuggauugaauacuggccua

SEQ ID NO: 12471 - RNA, 21 nt, Artificial Sequence
  Synthetic oligonucleotide
cuggauugaauacuggccuag

SEQ ID NO: 12472 - RNA, 21 nt, Artificial Sequence
  Synthetic oligonucleotide
cacaacauguucaucguguca

SEQ ID NO: 12473 - RNA, 21 nt, Artificial Sequence
  Synthetic oligonucleotide
acaacauguucaucgugucaa

SEQ ID NO: 12474 - RNA, 21 nt, Artificial Sequence
  Synthetic oligonucleotide
caacauguucaucgugucaag

SEQ ID NO: 12475 - RNA, 21 nt, Artificial Sequence
  Synthetic oligonucleotide
aacauguucaucgugucaagc

SEQ ID NO: 12476 - RNA, 21 nt, Artificial Sequence
  Synthetic oligonucleotide
cauguucaucgugucaagcau

SEQ ID NO: 12477 - RNA, 21 nt, Artificial Sequence
  Synthetic oligonucleotide
auguucaucgugucaagcauu

SEQ ID NO: 12478 - RNA, 21 nt, Artificial Sequence
  Synthetic oligonucleotide
uguucaucgugucaagcauuu

SEQ ID NO: 12479 - RNA, 21 nt, Artificial Sequence
  Synthetic oligonucleotide
guucaucgugucaagcauuuu

SEQ ID NO: 12480 - RNA, 21 nt, Artificial Sequence
  Synthetic oligonucleotide
ucaucgugucaagcauuuuua

SEQ ID NO: 12481 - RNA, 21 nt, Artificial Sequence
  Synthetic oligonucleotide
caucgugucaagcauuuuuag

SEQ ID NO: 12482 - RNA, 21 nt, Artificial Sequence
  Synthetic oligonucleotide
aucgugucaagcauuuuuagc

SEQ ID NO: 12483 - RNA, 21 nt, Artificial Sequence
  Synthetic oligonucleotide
cgugucaagcauuuuuagcua

SEQ ID NO: 12484 - RNA, 21 nt, Artificial Sequence
  Synthetic oligonucleotide
gugucaagcauuuuuagcuaa

SEQ ID NO: 12485 - RNA, 21 nt, Artificial Sequence
  Synthetic oligonucleotide
ugucaagcauuuuuagcuaau

SEQ ID NO: 12486 - RNA, 21 nt, Artificial Sequence
  Synthetic oligonucleotide
gucaagcauuuuuagcuaauu

SEQ ID NO: 12487 - RNA, 21 nt, Artificial Sequence
  Synthetic oligonucleotide
caagcauuuuuagcuaauuua

SEQ ID NO: 12488 - RNA, 21 nt, Artificial Sequence
  Synthetic oligonucleotide
aagcauuuuuagcuaauuuag

SEQ ID NO: 12489 - RNA, 21 nt, Artificial Sequence
  Synthetic oligonucleotide
agcauuuuuagcuaauuuaga

SEQ ID NO: 12490 - RNA, 21 nt, Artificial Sequence
  Synthetic oligonucleotide
gcauuuuuagcuaauuuagau

SEQ ID NO: 12491 - RNA, 21 nt, Artificial Sequence
  Synthetic oligonucleotide
cauuuuuagcuaauuuagaug

SEQ ID NO: 12492 - RNA, 21 nt, Artificial Sequence
  Synthetic oligonucleotide
auuuuuagcuaauuuagauga

SEQ ID NO: 12493 - RNA, 21 nt, Artificial Sequence
  Synthetic oligonucleotide
uuuuuagcuaauuuagaugaa

SEQ ID NO: 12494 - RNA, 21 nt, Artificial Sequence
  Synthetic oligonucleotide
uuuuagcuaauuuagaugaau

SEQ ID NO: 12495 - RNA, 21 nt, Artificial Sequence
  Synthetic oligonucleotide
uuuagcuaauuuagaugaauu

SEQ ID NO: 12496 - RNA, 21 nt, Artificial Sequence
  Synthetic oligonucleotide
uuagcuaauuuagaugaauuu

SEQ ID NO: 12497 - RNA, 21 nt, Artificial Sequence
  Synthetic oligonucleotide
uagcuaauuuagaugaauuug

SEQ ID NO: 12498 - RNA, 21 nt, Artificial Sequence
  Synthetic oligonucleotide
agcuaauuuagaugaauuugc

SEQ ID NO: 12499 - RNA, 21 nt, Artificial Sequence
  Synthetic oligonucleotide
auaucuuuuuaaauggaugcu

SEQ ID NO: 12500 - RNA, 21 nt, Artificial Sequence
  Synthetic oligonucleotide
uaucuuuuuaaauggaugcua

SEQ ID NO: 12501 - RNA, 21 nt, Artificial Sequence
  Synthetic oligonucleotide
aucuuuuuaaauggaugcuaa

SEQ ID NO: 12502 - RNA, 21 nt, Artificial Sequence
  Synthetic oligonucleotide
ucuuuuuaaauggaugcuaaa

SEQ ID NO: 12503 - RNA, 21 nt, Artificial Sequence
  Synthetic oligonucleotide
cuuuuuaaauggaugcuaaaa

SEQ ID NO: 12504 - RNA, 21 nt, Artificial Sequence
  Synthetic oligonucleotide
uuuuuaaauggaugcuaaaau

SEQ ID NO: 12505 - RNA, 21 nt, Artificial Sequence
  Synthetic oligonucleotide
uuuuaaauggaugcuaaaauu

SEQ ID NO: 12506 - RNA, 21 nt, Artificial Sequence
  Synthetic oligonucleotide
uuuaaauggaugcuaaaauuc

SEQ ID NO: 12507 - RNA, 21 nt, Artificial Sequence
  Synthetic oligonucleotide
uuaaauggaugcuaaaauucc

SEQ ID NO: 12508 - RNA, 21 nt, Artificial Sequence
  Synthetic oligonucleotide
uaaauggaugcuaaaauuccu

SEQ ID NO: 12509 - RNA, 21 nt, Artificial Sequence
  Synthetic oligonucleotide
aaauggaugcuaaaauuccug

SEQ ID NO: 12510 - RNA, 21 nt, Artificial Sequence
  Synthetic oligonucleotide
auggaugcuaaaauuccugaa

SEQ ID NO: 12511 - RNA, 21 nt, Artificial Sequence
  Synthetic oligonucleotide
uggaugcuaaaauuccugaag

SEQ ID NO: 12512 - RNA, 21 nt, Artificial Sequence
  Synthetic oligonucleotide
ggaugcuaaaauuccugaagu

SEQ ID NO: 12513 - RNA, 21 nt, Artificial Sequence
  Synthetic oligonucleotide
gaugcuaaaauuccugaaguu

SEQ ID NO: 12514 - RNA, 21 nt, Artificial Sequence
  Synthetic oligonucleotide
augcuaaaauuccugaaguuc

SEQ ID NO: 12515 - RNA, 21 nt, Artificial Sequence
  Synthetic oligonucleotide
ugcuaaaauuccugaaguuca

SEQ ID NO: 12516 - RNA, 21 nt, Artificial Sequence
  Synthetic oligonucleotide
gcuaaaauuccugaaguucag

SEQ ID NO: 12517 - RNA, 21 nt, Artificial Sequence
  Synthetic oligonucleotide
cuaaaauuccugaaguucagc

SEQ ID NO: 12518 - RNA, 21 nt, Artificial Sequence
  Synthetic oligonucleotide
uaaaauuccugaaguucagcu

SEQ ID NO: 12519 - RNA, 21 nt, Artificial Sequence
  Synthetic oligonucleotide
aaaauuccugaaguucagcug

SEQ ID NO: 12520 - RNA, 21 nt, Artificial Sequence
  Synthetic oligonucleotide
aaauuccugaaguucagcugc

SEQ ID NO: 12521 - RNA, 21 nt, Artificial Sequence
  Synthetic oligonucleotide
aauuccugaaguucagcugca

SEQ ID NO: 12522 - RNA, 21 nt, Artificial Sequence
  Synthetic oligonucleotide
auuccugaaguucagcugcau

SEQ ID NO: 12523 - RNA, 21 nt, Artificial Sequence
  Synthetic oligonucleotide
uuccugaaguucagcugcaua

SEQ ID NO: 12524 - RNA, 21 nt, Artificial Sequence
  Synthetic oligonucleotide
uccugaaguucagcugcauac

SEQ ID NO: 12525 - RNA, 21 nt, Artificial Sequence
  Synthetic oligonucleotide
ccugaaguucagcugcauaca

SEQ ID NO: 12526 - RNA, 21 nt, Artificial Sequence
  Synthetic oligonucleotide
cugaaguucagcugcauacag

SEQ ID NO: 12527 - RNA, 21 nt, Artificial Sequence
  Synthetic oligonucleotide
ugaaguucagcugcauacagu

SEQ ID NO: 12528 - RNA, 21 nt, Artificial Sequence
  Synthetic oligonucleotide
gaaguucagcugcauacaguu

SEQ ID NO: 12529 - RNA, 21 nt, Artificial Sequence
  Synthetic oligonucleotide
aaguucagcugcauacaguuu

SEQ ID NO: 12530 - RNA, 21 nt, Artificial Sequence
  Synthetic oligonucleotide
aguucagcugcauacaguuug

SEQ ID NO: 12531 - RNA, 21 nt, Artificial Sequence
  Synthetic oligonucleotide
guucagcugcauacaguuugc

SEQ ID NO: 12532 - RNA, 21 nt, Artificial Sequence
  Synthetic oligonucleotide
uucagcugcauacaguuugca

SEQ ID NO: 12533 - RNA, 21 nt, Artificial Sequence
  Synthetic oligonucleotide
ucagcugcauacaguuugcac

SEQ ID NO: 12534 - RNA, 21 nt, Artificial Sequence
  Synthetic oligonucleotide
cagcugcauacaguuugcacu

SEQ ID NO: 12535 - RNA, 21 nt, Artificial Sequence
  Synthetic oligonucleotide
agcugcauacaguuugcacuu

SEQ ID NO: 12536 - RNA, 21 nt, Artificial Sequence
  Synthetic oligonucleotide
gcugcauacaguuugcacuua

SEQ ID NO: 12537 - RNA, 21 nt, Artificial Sequence
  Synthetic oligonucleotide
cugcauacaguuugcacuuau

SEQ ID NO: 12538 - RNA, 21 nt, Artificial Sequence
  Synthetic oligonucleotide
ugcauacaguuugcacuuaug

SEQ ID NO: 12539 - RNA, 21 nt, Artificial Sequence
  Synthetic oligonucleotide
gcauacaguuugcacuuaugg

SEQ ID NO: 12540 - RNA, 21 nt, Artificial Sequence
  Synthetic oligonucleotide
cauacaguuugcacuuaugga

SEQ ID NO: 12541 - RNA, 21 nt, Artificial Sequence
  Synthetic oligonucleotide
auacaguuugcacuuauggac

SEQ ID NO: 12542 - RNA, 21 nt, Artificial Sequence
  Synthetic oligonucleotide
uacaguuugcacuuauggacu

SEQ ID NO: 12543 - RNA, 21 nt, Artificial Sequence
  Synthetic oligonucleotide
acaguuugcacuuauggacuc

SEQ ID NO: 12544 - RNA, 21 nt, Artificial Sequence
  Synthetic oligonucleotide
caguuugcacuuauggacucc

SEQ ID NO: 12545 - RNA, 21 nt, Artificial Sequence
  Synthetic oligonucleotide
aguuugcacuuauggacuccu

SEQ ID NO: 12546 - RNA, 21 nt, Artificial Sequence
  Synthetic oligonucleotide
guuugcacuuauggacuccug

SEQ ID NO: 12547 - RNA, 21 nt, Artificial Sequence
  Synthetic oligonucleotide
uuugcacuuauggacuccugu

SEQ ID NO: 12548 - RNA, 21 nt, Artificial Sequence
  Synthetic oligonucleotide
uugcacuuauggacuccuguu

SEQ ID NO: 12549 - RNA, 21 nt, Artificial Sequence
  Synthetic oligonucleotide
ugcacuuauggacuccuguug

SEQ ID NO: 12550 - RNA, 21 nt, Artificial Sequence
  Synthetic oligonucleotide
gcacuuauggacuccuguugu

SEQ ID NO: 12551 - RNA, 21 nt, Artificial Sequence
  Synthetic oligonucleotide
cacuuauggacuccuguuguu

SEQ ID NO: 12552 - RNA, 21 nt, Artificial Sequence
  Synthetic oligonucleotide
acuuauggacuccuguuguug

SEQ ID NO: 12553 - RNA, 21 nt, Artificial Sequence
  Synthetic oligonucleotide
cuuauggacuccuguuguuga

SEQ ID NO: 12554 - RNA, 21 nt, Artificial Sequence
  Synthetic oligonucleotide
uauggacuccuguuguugaag

SEQ ID NO: 12555 - RNA, 21 nt, Artificial Sequence
  Synthetic oligonucleotide
auagcuggucuuauuuguaaa

SEQ ID NO: 12556 - RNA, 21 nt, Artificial Sequence
  Synthetic oligonucleotide
uagcuggucuuauuuguaaag

SEQ ID NO: 12557 - RNA, 21 nt, Artificial Sequence
  Synthetic oligonucleotide
agcuggucuuauuuguaaagc

SEQ ID NO: 12558 - RNA, 21 nt, Artificial Sequence
  Synthetic oligonucleotide
gcuggucuuauuuguaaagcu

SEQ ID NO: 12559 - RNA, 21 nt, Artificial Sequence
  Synthetic oligonucleotide
cuggucuuauuuguaaagcuc

SEQ ID NO: 12560 - RNA, 21 nt, Artificial Sequence
  Synthetic oligonucleotide
uggucuuauuuguaaagcuca

SEQ ID NO: 12561 - RNA, 21 nt, Artificial Sequence
  Synthetic oligonucleotide
ggucuuauuuguaaagcucac

SEQ ID NO: 12562 - RNA, 21 nt, Artificial Sequence
  Synthetic oligonucleotide
gucuuauuuguaaagcucacu

SEQ ID NO: 12563 - RNA, 21 nt, Artificial Sequence
  Synthetic oligonucleotide
ucuuauuuguaaagcucacuu

SEQ ID NO: 12564 - RNA, 21 nt, Artificial Sequence
  Synthetic oligonucleotide
cuuauuuguaaagcucacuuu

SEQ ID NO: 12565 - RNA, 21 nt, Artificial Sequence
  Synthetic oligonucleotide
uuauuuguaaagcucacuuua

SEQ ID NO: 12566 - RNA, 21 nt, Artificial Sequence
  Synthetic oligonucleotide
uauuuguaaagcucacuuuac

SEQ ID NO: 12567 - RNA, 21 nt, Artificial Sequence
  Synthetic oligonucleotide
auuuguaaagcucacuuuacu

SEQ ID NO: 12568 - RNA, 21 nt, Artificial Sequence
  Synthetic oligonucleotide
uuuguaaagcucacuuuacuu

SEQ ID NO: 12569 - RNA, 21 nt, Artificial Sequence
  Synthetic oligonucleotide
uuguaaagcucacuuuacuua

SEQ ID NO: 12570 - RNA, 21 nt, Artificial Sequence
  Synthetic oligonucleotide
uguaaagcucacuuuacuuag

SEQ ID NO: 12571 - RNA, 21 nt, Artificial Sequence
  Synthetic oligonucleotide
guaaagcucacuuuacuuaga

SEQ ID NO: 12572 - RNA, 21 nt, Artificial Sequence
  Synthetic oligonucleotide
uaaagcucacuuuacuuagaa

SEQ ID NO: 12573 - RNA, 21 nt, Artificial Sequence
  Synthetic oligonucleotide
aaagcucacuuuacuuagaau

SEQ ID NO: 12574 - RNA, 21 nt, Artificial Sequence
  Synthetic oligonucleotide
aagcucacuuuacuuagaauu

SEQ ID NO: 12575 - RNA, 21 nt, Artificial Sequence
  Synthetic oligonucleotide
agcucacuuuacuuagaauua

SEQ ID NO: 12576 - RNA, 21 nt, Artificial Sequence
  Synthetic oligonucleotide
gcucacuuuacuuagaauuag

SEQ ID NO: 12577 - RNA, 21 nt, Artificial Sequence
  Synthetic oligonucleotide
cucacuuuacuuagaauuagu

SEQ ID NO: 12578 - RNA, 21 nt, Artificial Sequence
  Synthetic oligonucleotide
ucacuuuacuuagaauuagug

SEQ ID NO: 12579 - RNA, 21 nt, Artificial Sequence
  Synthetic oligonucleotide
cacuuuacuuagaauuagugg

SEQ ID NO: 12580 - RNA, 21 nt, Artificial Sequence
  Synthetic oligonucleotide
acuuuacuuagaauuaguggc

SEQ ID NO: 12581 - RNA, 21 nt, Artificial Sequence
  Synthetic oligonucleotide
cuuuacuuagaauuaguggca

SEQ ID NO: 12582 - RNA, 21 nt, Artificial Sequence
  Synthetic oligonucleotide
uuuacuuagaauuaguggcac

SEQ ID NO: 12583 - RNA, 21 nt, Artificial Sequence
  Synthetic oligonucleotide
uuacuuagaauuaguggcacu

SEQ ID NO: 12584 - RNA, 21 nt, Artificial Sequence
  Synthetic oligonucleotide
uacuuagaauuaguggcacuu

SEQ ID NO: 12585 - RNA, 21 nt, Artificial Sequence
  Synthetic oligonucleotide
acuuagaauuaguggcacuug

SEQ ID NO: 12586 - RNA, 21 nt, Artificial Sequence
  Synthetic oligonucleotide
cuuagaauuaguggcacuugc

SEQ ID NO: 12587 - RNA, 21 nt, Artificial Sequence
  Synthetic oligonucleotide
uuagaauuaguggcacuugcu

SEQ ID NO: 12588 - RNA, 21 nt, Artificial Sequence
  Synthetic oligonucleotide
uagaauuaguggcacuugcuu

SEQ ID NO: 12589 - RNA, 21 nt, Artificial Sequence
  Synthetic oligonucleotide
agaauuaguggcacuugcuuu

SEQ ID NO: 12590 - RNA, 21 nt, Artificial Sequence
  Synthetic oligonucleotide
gaauuaguggcacuugcuuuu

SEQ ID NO: 12591 - RNA, 21 nt, Artificial Sequence
  Synthetic oligonucleotide
aauuaguggcacuugcuuuua

SEQ ID NO: 12592 - RNA, 21 nt, Artificial Sequence
  Synthetic oligonucleotide
auuaguggcacuugcuuuuau

SEQ ID NO: 12593 - RNA, 21 nt, Artificial Sequence
  Synthetic oligonucleotide
uuaguggcacuugcuuuuauu

SEQ ID NO: 12594 - RNA, 21 nt, Artificial Sequence
  Synthetic oligonucleotide
uaguggcacuugcuuuuauua

SEQ ID NO: 12595 - RNA, 21 nt, Artificial Sequence
  Synthetic oligonucleotide
aguggcacuugcuuuuauuag

SEQ ID NO: 12596 - RNA, 21 nt, Artificial Sequence
  Synthetic oligonucleotide
guggcacuugcuuuuauuaga

SEQ ID NO: 12597 - RNA, 21 nt, Artificial Sequence
  Synthetic oligonucleotide
uggcacuugcuuuuauuagag

SEQ ID NO: 12598 - RNA, 21 nt, Artificial Sequence
  Synthetic oligonucleotide
ggcacuugcuuuuauuagaga

SEQ ID NO: 12599 - RNA, 21 nt, Artificial Sequence
  Synthetic oligonucleotide
gcacuugcuuuuauuagagaa

SEQ ID NO: 12600 - RNA, 21 nt, Artificial Sequence
  Synthetic oligonucleotide
cacuugcuuuuauuagagaau

SEQ ID NO: 12601 - RNA, 21 nt, Artificial Sequence
  Synthetic oligonucleotide
gcuuuuauuagagaaugauuu

SEQ ID NO: 12602 - RNA, 21 nt, Artificial Sequence
  Synthetic oligonucleotide
augcuguaacuuucugaaaua

SEQ ID NO: 12603 - RNA, 21 nt, Artificial Sequence
  Synthetic oligonucleotide
ugcuguaacuuucugaaauaa

SEQ ID NO: 12604 - RNA, 21 nt, Artificial Sequence
  Synthetic oligonucleotide
gcuguaacuuucugaaauaac

SEQ ID NO: 12605 - RNA, 21 nt, Artificial Sequence
  Synthetic oligonucleotide
cuguaacuuucugaaauaaca

SEQ ID NO: 12606 - RNA, 21 nt, Artificial Sequence
  Synthetic oligonucleotide
uguaacuuucugaaauaacau

SEQ ID NO: 12607 - RNA, 21 nt, Artificial Sequence
  Synthetic oligonucleotide
guaacuuucugaaauaacaug

SEQ ID NO: 12608 - RNA, 21 nt, Artificial Sequence
  Synthetic oligonucleotide
uaacuuucugaaauaacaugg

SEQ ID NO: 12609 - RNA, 21 nt, Artificial Sequence
  Synthetic oligonucleotide
aacuuucugaaauaacauggc

SEQ ID NO: 12610 - RNA, 21 nt, Artificial Sequence
  Synthetic oligonucleotide
acuuucugaaauaacauggcc

SEQ ID NO: 12611 - RNA, 21 nt, Artificial Sequence
  Synthetic oligonucleotide
cuuucugaaauaacauggccu

SEQ ID NO: 12612 - RNA, 21 nt, Artificial Sequence
  Synthetic oligonucleotide
uuucugaaauaacauggccuu

SEQ ID NO: 12613 - RNA, 21 nt, Artificial Sequence
  Synthetic oligonucleotide
uucugaaauaacauggccuug

SEQ ID NO: 12614 - RNA, 21 nt, Artificial Sequence
  Synthetic oligonucleotide
ucugaaauaacauggccuugg

SEQ ID NO: 12615 - RNA, 21 nt, Artificial Sequence
  Synthetic oligonucleotide
cugaaauaacauggccuugga

SEQ ID NO: 12616 - RNA, 21 nt, Artificial Sequence
  Synthetic oligonucleotide
ugaaauaacauggccuuggag

SEQ ID NO: 12617 - RNA, 21 nt, Artificial Sequence
  Synthetic oligonucleotide
gaaauaacauggccuuggagg

SEQ ID NO: 12618 - RNA, 21 nt, Artificial Sequence
  Synthetic oligonucleotide
aaauaacauggccuuggaggg

SEQ ID NO: 12619 - RNA, 21 nt, Artificial Sequence
  Synthetic oligonucleotide
aauaacauggccuuggagggc

SEQ ID NO: 12620 - RNA, 21 nt, Artificial Sequence
  Synthetic oligonucleotide
auaacauggccuuggagggca

SEQ ID NO: 12621 - RNA, 21 nt, Artificial Sequence
  Synthetic oligonucleotide
uaacauggccuuggagggcau

SEQ ID NO: 12622 - RNA, 21 nt, Artificial Sequence
  Synthetic oligonucleotide
aacauggccuuggagggcaug

SEQ ID NO: 12623 - RNA, 21 nt, Artificial Sequence
  Synthetic oligonucleotide
acauggccuuggagggcauga

SEQ ID NO: 12624 - RNA, 21 nt, Artificial Sequence
  Synthetic oligonucleotide
cauggccuuggagggcaugaa

SEQ ID NO: 12625 - RNA, 21 nt, Artificial Sequence
  Synthetic oligonucleotide
auggccuuggagggcaugaag

SEQ ID NO: 12626 - RNA, 21 nt, Artificial Sequence
  Synthetic oligonucleotide
uggccuuggagggcaugaaga

SEQ ID NO: 12627 - RNA, 21 nt, Artificial Sequence
  Synthetic oligonucleotide
ggccuuggagggcaugaagac

SEQ ID NO: 12628 - RNA, 21 nt, Artificial Sequence
  Synthetic oligonucleotide
gccuuggagggcaugaagaca

SEQ ID NO: 12629 - RNA, 21 nt, Artificial Sequence
  Synthetic oligonucleotide
ccuuggagggcaugaagacag

SEQ ID NO: 12630 - RNA, 21 nt, Artificial Sequence
  Synthetic oligonucleotide
cuuggagggcaugaagacaga

SEQ ID NO: 12631 - RNA, 21 nt, Artificial Sequence
  Synthetic oligonucleotide
uuggagggcaugaagacagau

SEQ ID NO: 12632 - RNA, 21 nt, Artificial Sequence
  Synthetic oligonucleotide
uggagggcaugaagacagaua

SEQ ID NO: 12633 - RNA, 21 nt, Artificial Sequence
  Synthetic oligonucleotide
ggagggcaugaagacagauac

SEQ ID NO: 12634 - RNA, 21 nt, Artificial Sequence
  Synthetic oligonucleotide
gagggcaugaagacagauacu

SEQ ID NO: 12635 - RNA, 21 nt, Artificial Sequence
  Synthetic oligonucleotide
agggcaugaagacagauacuc

SEQ ID NO: 12636 - RNA, 21 nt, Artificial Sequence
  Synthetic oligonucleotide
gggcaugaagacagauacucc

SEQ ID NO: 12637 - RNA, 21 nt, Artificial Sequence
  Synthetic oligonucleotide
ggcaugaagacagauacuccu

SEQ ID NO: 12638 - RNA, 21 nt, Artificial Sequence
  Synthetic oligonucleotide
gcaugaagacagauacuccuc

SEQ ID NO: 12639 - RNA, 21 nt, Artificial Sequence
  Synthetic oligonucleotide
caugaagacagauacuccucc

SEQ ID NO: 12640 - RNA, 21 nt, Artificial Sequence
  Synthetic oligonucleotide
augaagacagauacuccucca

SEQ ID NO: 12641 - RNA, 21 nt, Artificial Sequence
  Synthetic oligonucleotide
ugaagacagauacuccuccaa

SEQ ID NO: 12642 - RNA, 21 nt, Artificial Sequence
  Synthetic oligonucleotide
gaagacagauacuccuccaag

SEQ ID NO: 12643 - RNA, 21 nt, Artificial Sequence
  Synthetic oligonucleotide
aagacagauacuccuccaagg

SEQ ID NO: 12644 - RNA, 21 nt, Artificial Sequence
  Synthetic oligonucleotide
agacagauacuccuccaaggu

SEQ ID NO: 12645 - RNA, 21 nt, Artificial Sequence
  Synthetic oligonucleotide
acagauacuccuccaagguua

SEQ ID NO: 12646 - RNA, 21 nt, Artificial Sequence
  Synthetic oligonucleotide
cagauacuccuccaagguuau

SEQ ID NO: 12647 - RNA, 21 nt, Artificial Sequence
  Synthetic oligonucleotide
agauacuccuccaagguuauu

SEQ ID NO: 12648 - RNA, 21 nt, Artificial Sequence
  Synthetic oligonucleotide
gauacuccuccaagguuauug

SEQ ID NO: 12649 - RNA, 21 nt, Artificial Sequence
  Synthetic oligonucleotide
auacuccuccaagguuauugg

SEQ ID NO: 12650 - RNA, 21 nt, Artificial Sequence
  Synthetic oligonucleotide
uacuccuccaagguuauugga

SEQ ID NO: 12651 - RNA, 21 nt, Artificial Sequence
  Synthetic oligonucleotide
acuccuccaagguuauuggac

SEQ ID NO: 12652 - RNA, 21 nt, Artificial Sequence
  Synthetic oligonucleotide
cuccuccaagguuauuggaca

SEQ ID NO: 12653 - RNA, 21 nt, Artificial Sequence
  Synthetic oligonucleotide
uccuccaagguuauuggacac

SEQ ID NO: 12654 - RNA, 21 nt, Artificial Sequence
  Synthetic oligonucleotide
ccuccaagguuauuggacacc

SEQ ID NO: 12655 - RNA, 21 nt, Artificial Sequence
  Synthetic oligonucleotide
cuccaagguuauuggacaccg

SEQ ID NO: 12656 - RNA, 21 nt, Artificial Sequence
  Synthetic oligonucleotide
uccaagguuauuggacaccgg

SEQ ID NO: 12657 - RNA, 21 nt, Artificial Sequence
  Synthetic oligonucleotide
ccaagguuauuggacaccgga

SEQ ID NO: 12658 - RNA, 21 nt, Artificial Sequence
  Synthetic oligonucleotide
caagguuauuggacaccggaa

SEQ ID NO: 12659 - RNA, 21 nt, Artificial Sequence
  Synthetic oligonucleotide
aagguuauuggacaccggaaa

SEQ ID NO: 12660 - RNA, 21 nt, Artificial Sequence
  Synthetic oligonucleotide
agguuauuggacaccggaaac

SEQ ID NO: 12661 - RNA, 21 nt, Artificial Sequence
  Synthetic oligonucleotide
gguuauuggacaccggaaaca

SEQ ID NO: 12662 - RNA, 21 nt, Artificial Sequence
  Synthetic oligonucleotide
guuauuggacaccggaaacaa

SEQ ID NO: 12663 - RNA, 21 nt, Artificial Sequence
  Synthetic oligonucleotide
uuauuggacaccggaaacaau

SEQ ID NO: 12664 - RNA, 21 nt, Artificial Sequence
  Synthetic oligonucleotide
uauuggacaccggaaacaaua

SEQ ID NO: 12665 - RNA, 21 nt, Artificial Sequence
  Synthetic oligonucleotide
auuggacaccggaaacaauaa

SEQ ID NO: 12666 - RNA, 21 nt, Artificial Sequence
  Synthetic oligonucleotide
uuggacaccggaaacaauaaa

SEQ ID NO: 12667 - RNA, 21 nt, Artificial Sequence
  Synthetic oligonucleotide
uggacaccggaaacaauaaau

SEQ ID NO: 12668 - RNA, 21 nt, Artificial Sequence
  Synthetic oligonucleotide
ggacaccggaaacaauaaauu

SEQ ID NO: 12669 - RNA, 21 nt, Artificial Sequence
  Synthetic oligonucleotide
uggaacaccuccucaaaccua

SEQ ID NO: 12670 - RNA, 21 nt, Artificial Sequence
  Synthetic oligonucleotide
ggaacaccuccucaaaccuac

SEQ ID NO: 12671 - RNA, 21 nt, Artificial Sequence
  Synthetic oligonucleotide
gaacaccuccucaaaccuacc

SEQ ID NO: 12672 - RNA, 21 nt, Artificial Sequence
  Synthetic oligonucleotide
aacaccuccucaaaccuacca

SEQ ID NO: 12673 - RNA, 21 nt, Artificial Sequence
  Synthetic oligonucleotide
acaccuccucaaaccuaccac

SEQ ID NO: 12674 - RNA, 21 nt, Artificial Sequence
  Synthetic oligonucleotide
caccuccucaaaccuaccacu

SEQ ID NO: 12675 - RNA, 21 nt, Artificial Sequence
  Synthetic oligonucleotide
gggccgaaagaacaguccauu

SEQ ID NO: 12676 - RNA, 21 nt, Artificial Sequence
  Synthetic oligonucleotide
ggccgaaagaacaguccauug

SEQ ID NO: 12677 - RNA, 21 nt, Artificial Sequence
  Synthetic oligonucleotide
gccgaaagaacaguccauuga

SEQ ID NO: 12678 - RNA, 21 nt, Artificial Sequence
  Synthetic oligonucleotide
ccgaaagaacaguccauugaa

SEQ ID NO: 12679 - RNA, 21 nt, Artificial Sequence
  Synthetic oligonucleotide
cgaaagaacaguccauugaaa

SEQ ID NO: 12680 - RNA, 21 nt, Artificial Sequence
  Synthetic oligonucleotide
agggaguauuacaaaaacaug

SEQ ID NO: 12681 - RNA, 21 nt, Artificial Sequence
  Synthetic oligonucleotide
gggaguauuacaaaaacaugg

SEQ ID NO: 12682 - RNA, 21 nt, Artificial Sequence
  Synthetic oligonucleotide
ggaguauuacaaaaacauggc

SEQ ID NO: 12683 - RNA, 21 nt, Artificial Sequence
  Synthetic oligonucleotide
gaguauuacaaaaacauggcc

SEQ ID NO: 12684 - RNA, 21 nt, Artificial Sequence
  Synthetic oligonucleotide
aguauuacaaaaacauggccu

SEQ ID NO: 12685 - RNA, 21 nt, Artificial Sequence
  Synthetic oligonucleotide
guauuacaaaaacauggccuu

SEQ ID NO: 12686 - RNA, 21 nt, Artificial Sequence
  Synthetic oligonucleotide
uauuacaaaaacauggccuuu

SEQ ID NO: 12687 - RNA, 21 nt, Artificial Sequence
  Synthetic oligonucleotide
auuacaaaaacauggccuuug

SEQ ID NO: 12688 - RNA, 21 nt, Artificial Sequence
  Synthetic oligonucleotide
uuacaaaaacauggccuuugc

SEQ ID NO: 12689 - RNA, 21 nt, Artificial Sequence
  Synthetic oligonucleotide
uacaaaaacauggccuuugcu

SEQ ID NO: 12690 - RNA, 21 nt, Artificial Sequence
  Synthetic oligonucleotide
acaaaaacauggccuuugcuu

SEQ ID NO: 12691 - RNA, 21 nt, Artificial Sequence
  Synthetic oligonucleotide
caaaaacauggccuuugcuug

SEQ ID NO: 12692 - RNA, 21 nt, Artificial Sequence
  Synthetic oligonucleotide
aaaaacauggccuuugcuuga

SEQ ID NO: 12693 - RNA, 21 nt, Artificial Sequence
  Synthetic oligonucleotide
aaaacauggccuuugcuugaa

SEQ ID NO: 12694 - RNA, 21 nt, Artificial Sequence
  Synthetic oligonucleotide
aaacauggccuuugcuugaaa

SEQ ID NO: 12695 - RNA, 21 nt, Artificial Sequence
  Synthetic oligonucleotide
aacauggccuuugcuugaaag

SEQ ID NO: 12696 - RNA, 21 nt, Artificial Sequence
  Synthetic oligonucleotide
acauggccuuugcuugaaaga

SEQ ID NO: 12697 - RNA, 21 nt, Artificial Sequence
  Synthetic oligonucleotide
cauggccuuugcuugaaagaa

SEQ ID NO: 12698 - RNA, 21 nt, Artificial Sequence
  Synthetic oligonucleotide
auggccuuugcuugaaagaaa

SEQ ID NO: 12699 - RNA, 21 nt, Artificial Sequence
  Synthetic oligonucleotide
uggccuuugcuugaaagaaaa

SEQ ID NO: 12700 - RNA, 21 nt, Artificial Sequence
  Synthetic oligonucleotide
ggccuuugcuugaaagaaaau

SEQ ID NO: 12701 - RNA, 21 nt, Artificial Sequence
  Synthetic oligonucleotide
gccuuugcuugaaagaaaaua

SEQ ID NO: 12702 - RNA, 21 nt, Artificial Sequence
  Synthetic oligonucleotide
ccuuugcuugaaagaaaauac

SEQ ID NO: 12703 - RNA, 21 nt, Artificial Sequence
  Synthetic oligonucleotide
cuuugcuugaaagaaaauacc

SEQ ID NO: 12704 - RNA, 21 nt, Artificial Sequence
  Synthetic oligonucleotide
uuugcuugaaagaaaauacca

SEQ ID NO: 12705 - RNA, 21 nt, Artificial Sequence
  Synthetic oligonucleotide
gaacaggaaacugaucauuaa

SEQ ID NO: 12706 - RNA, 21 nt, Artificial Sequence
  Synthetic oligonucleotide
aacaggaaacugaucauuaaa

SEQ ID NO: 12707 - RNA, 21 nt, Artificial Sequence
  Synthetic oligonucleotide
acaggaaacugaucauuaaag

SEQ ID NO: 12708 - RNA, 21 nt, Artificial Sequence
  Synthetic oligonucleotide
caggaaacugaucauuaaagc

SEQ ID NO: 12709 - RNA, 21 nt, Artificial Sequence
  Synthetic oligonucleotide
aggaaacugaucauuaaagcc

SEQ ID NO: 12710 - RNA, 21 nt, Artificial Sequence
  Synthetic oligonucleotide
ggaaacugaucauuaaagccu

SEQ ID NO: 12711 - RNA, 21 nt, Artificial Sequence
  Synthetic oligonucleotide
gaaacugaucauuaaagccug

SEQ ID NO: 12712 - RNA, 21 nt, Artificial Sequence
  Synthetic oligonucleotide
aaacugaucauuaaagccuga

SEQ ID NO: 12713 - RNA, 21 nt, Artificial Sequence
  Synthetic oligonucleotide
aacugaucauuaaagccugag

SEQ ID NO: 12714 - RNA, 21 nt, Artificial Sequence
  Synthetic oligonucleotide
acugaucauuaaagccugagu

SEQ ID NO: 12715 - RNA, 21 nt, Artificial Sequence
  Synthetic oligonucleotide
cugaucauuaaagccugaguu

SEQ ID NO: 12716 - RNA, 21 nt, Artificial Sequence
  Synthetic oligonucleotide
ugaucauuaaagccugaguuu

SEQ ID NO: 12717 - RNA, 21 nt, Artificial Sequence
  Synthetic oligonucleotide
gaucauuaaagccugaguuug

SEQ ID NO: 12718 - RNA, 21 nt, Artificial Sequence
  Synthetic oligonucleotide
cauuaaagccugaguuugcuu

SEQ ID NO: 12719 - RNA, 21 nt, Artificial Sequence
  Synthetic oligonucleotide
auuaaagccugaguuugcuuu

SEQ ID NO: 12720 - RNA, 27 nt, Artificial Sequence
  Synthetic oligonucleotide
uccugcuaccuccaaccaugggccuuu

SEQ ID NO: 12721 - RNA, 27 nt, Artificial Sequence
  Synthetic oligonucleotide
ccugcuaccuccaaccaugggccuuuu

SEQ ID NO: 12722 - RNA, 27 nt, Artificial Sequence
  Synthetic oligonucleotide
cugcuaccuccaaccaugggccuuuug

SEQ ID NO: 12723 - RNA, 27 nt, Artificial Sequence
  Synthetic oligonucleotide
ugcuaccuccaaccaugggccuuuugg

SEQ ID NO: 12724 - RNA, 27 nt, Artificial Sequence
  Synthetic oligonucleotide
uaccuccaaccaugggccuuuugggaa

SEQ ID NO: 12725 - RNA, 27 nt, Artificial Sequence
  Synthetic oligonucleotide
accuccaaccaugggccuuuugggaau

SEQ ID NO: 12726 - RNA, 27 nt, Artificial Sequence
  Synthetic oligonucleotide
ccuccaaccaugggccuuuugggaaua

SEQ ID NO: 12727 - RNA, 27 nt, Artificial Sequence
  Synthetic oligonucleotide
cuccaaccaugggccuuuugggaauac

SEQ ID NO: 12728 - RNA, 27 nt, Artificial Sequence
  Synthetic oligonucleotide
uccaaccaugggccuuuugggaauacu

SEQ ID NO: 12729 - RNA, 27 nt, Artificial Sequence
  Synthetic oligonucleotide
ccaaccaugggccuuuugggaauacuu

SEQ ID NO: 12730 - RNA, 27 nt, Artificial Sequence
  Synthetic oligonucleotide
caaccaugggccuuuugggaauacuuu

SEQ ID NO: 12731 - RNA, 27 nt, Artificial Sequence
  Synthetic oligonucleotide
aaccaugggccuuuugggaauacuuug

SEQ ID NO: 12732 - RNA, 27 nt, Artificial Sequence
  Synthetic oligonucleotide
accaugggccuuuugggaauacuuugu

SEQ ID NO: 12733 - RNA, 27 nt, Artificial Sequence
  Synthetic oligonucleotide
ccaugggccuuuugggaauacuuuguu

SEQ ID NO: 12734 - RNA, 27 nt, Artificial Sequence
  Synthetic oligonucleotide
caugggccuuuugggaauacuuuguuu

SEQ ID NO: 12735 - RNA, 27 nt, Artificial Sequence
  Synthetic oligonucleotide
augggccuuuugggaauacuuuguuuu

SEQ ID NO: 12736 - RNA, 27 nt, Artificial Sequence
  Synthetic oligonucleotide
ugggccuuuugggaauacuuuguuuuu

SEQ ID NO: 12737 - RNA, 27 nt, Artificial Sequence
  Synthetic oligonucleotide
gggccuuuugggaauacuuuguuuuuu

SEQ ID NO: 12738 - RNA, 27 nt, Artificial Sequence
  Synthetic oligonucleotide
ggccuuuugggaauacuuuguuuuuua

SEQ ID NO: 12739 - RNA, 27 nt, Artificial Sequence
  Synthetic oligonucleotide
gccuuuugggaauacuuuguuuuuuaa

SEQ ID NO: 12740 - RNA, 27 nt, Artificial Sequence
  Synthetic oligonucleotide
ccuuuugggaauacuuuguuuuuuaau

SEQ ID NO: 12741 - RNA, 27 nt, Artificial Sequence
  Synthetic oligonucleotide
cuuuugggaauacuuuguuuuuuaauc

SEQ ID NO: 12742 - RNA, 27 nt, Artificial Sequence
  Synthetic oligonucleotide
uuuugggaauacuuuguuuuuuaaucu

SEQ ID NO: 12743 - RNA, 27 nt, Artificial Sequence
  Synthetic oligonucleotide
uuugggaauacuuuguuuuuuaaucuu

SEQ ID NO: 12744 - RNA, 27 nt, Artificial Sequence
  Synthetic oligonucleotide
uugggaauacuuuguuuuuuaaucuuc

SEQ ID NO: 12745 - RNA, 27 nt, Artificial Sequence
  Synthetic oligonucleotide
ugggaauacuuuguuuuuuaaucuucc

SEQ ID NO: 12746 - RNA, 27 nt, Artificial Sequence
  Synthetic oligonucleotide
gggaauacuuuguuuuuuaaucuuccu

SEQ ID NO: 12747 - RNA, 27 nt, Artificial Sequence
  Synthetic oligonucleotide
ggaauacuuuguuuuuuaaucuuccug

SEQ ID NO: 12748 - RNA, 27 nt, Artificial Sequence
  Synthetic oligonucleotide
gaauacuuuguuuuuuaaucuuccugg

SEQ ID NO: 12749 - RNA, 27 nt, Artificial Sequence
  Synthetic oligonucleotide
aauacuuuguuuuuuaaucuuccuggg

SEQ ID NO: 12750 - RNA, 27 nt, Artificial Sequence
  Synthetic oligonucleotide
auacuuuguuuuuuaaucuuccugggg

SEQ ID NO: 12751 - RNA, 27 nt, Artificial Sequence
  Synthetic oligonucleotide
uacuuuguuuuuuaaucuuccugggga

SEQ ID NO: 12752 - RNA, 27 nt, Artificial Sequence
  Synthetic oligonucleotide
acuuuguuuuuuaaucuuccuggggaa

SEQ ID NO: 12753 - RNA, 27 nt, Artificial Sequence
  Synthetic oligonucleotide
cuuuguuuuuuaaucuuccuggggaaa

SEQ ID NO: 12754 - RNA, 27 nt, Artificial Sequence
  Synthetic oligonucleotide
uuuguuuuuuaaucuuccuggggaaaa

SEQ ID NO: 12755 - RNA, 27 nt, Artificial Sequence
  Synthetic oligonucleotide
uuguuuuuuaaucuuccuggggaaaac

SEQ ID NO: 12756 - RNA, 27 nt, Artificial Sequence
  Synthetic oligonucleotide
ccuggggacaggagcaaacauauguca

SEQ ID NO: 12757 - RNA, 27 nt, Artificial Sequence
  Synthetic oligonucleotide
cuggggacaggagcaaacauaugucau

SEQ ID NO: 12758 - RNA, 27 nt, Artificial Sequence
  Synthetic oligonucleotide
uggggacaggagcaaacauaugucauu

SEQ ID NO: 12759 - RNA, 27 nt, Artificial Sequence
  Synthetic oligonucleotide
ggggacaggagcaaacauaugucauuu

SEQ ID NO: 12760 - RNA, 27 nt, Artificial Sequence
  Synthetic oligonucleotide
gggacaggagcaaacauaugucauuuc

SEQ ID NO: 12761 - RNA, 27 nt, Artificial Sequence
  Synthetic oligonucleotide
ggacaggagcaaacauaugucauuuca

SEQ ID NO: 12762 - RNA, 27 nt, Artificial Sequence
  Synthetic oligonucleotide
gacaggagcaaacauaugucauuucag

SEQ ID NO: 12763 - RNA, 27 nt, Artificial Sequence
  Synthetic oligonucleotide
acaggagcaaacauaugucauuucagc

SEQ ID NO: 12764 - RNA, 27 nt, Artificial Sequence
  Synthetic oligonucleotide
caggagcaaacauaugucauuucagca

SEQ ID NO: 12765 - RNA, 27 nt, Artificial Sequence
  Synthetic oligonucleotide
aggagcaaacauaugucauuucagcac

SEQ ID NO: 12766 - RNA, 27 nt, Artificial Sequence
  Synthetic oligonucleotide
ggagcaaacauaugucauuucagcacc

SEQ ID NO: 12767 - RNA, 27 nt, Artificial Sequence
  Synthetic oligonucleotide
gagcaaacauaugucauuucagcacca

SEQ ID NO: 12768 - RNA, 27 nt, Artificial Sequence
  Synthetic oligonucleotide
agcaaacauaugucauuucagcaccaa

SEQ ID NO: 12769 - RNA, 27 nt, Artificial Sequence
  Synthetic oligonucleotide
gcaaacauaugucauuucagcaccaaa

SEQ ID NO: 12770 - RNA, 27 nt, Artificial Sequence
  Synthetic oligonucleotide
caaacauaugucauuucagcaccaaaa

SEQ ID NO: 12771 - RNA, 27 nt, Artificial Sequence
  Synthetic oligonucleotide
aaacauaugucauuucagcaccaaaaa

SEQ ID NO: 12772 - RNA, 27 nt, Artificial Sequence
  Synthetic oligonucleotide
aacauaugucauuucagcaccaaaaau

SEQ ID NO: 12773 - RNA, 27 nt, Artificial Sequence
  Synthetic oligonucleotide
cauaugucauuucagcaccaaaaauau

SEQ ID NO: 12774 - RNA, 27 nt, Artificial Sequence
  Synthetic oligonucleotide
auaugucauuucagcaccaaaaauauu

SEQ ID NO: 12775 - RNA, 27 nt, Artificial Sequence
  Synthetic oligonucleotide
uaugucauuucagcaccaaaaauauuc

SEQ ID NO: 12776 - RNA, 27 nt, Artificial Sequence
  Synthetic oligonucleotide
augucauuucagcaccaaaaauauucc

SEQ ID NO: 12777 - RNA, 27 nt, Artificial Sequence
  Synthetic oligonucleotide
ugucauuucagcaccaaaaauauuccg

SEQ ID NO: 12778 - RNA, 27 nt, Artificial Sequence
  Synthetic oligonucleotide
gucauuucagcaccaaaaauauuccgu

SEQ ID NO: 12779 - RNA, 27 nt, Artificial Sequence
  Synthetic oligonucleotide
ucauuucagcaccaaaaauauuccgug

SEQ ID NO: 12780 - RNA, 27 nt, Artificial Sequence
  Synthetic oligonucleotide
cauuucagcaccaaaaauauuccgugu

SEQ ID NO: 12781 - RNA, 27 nt, Artificial Sequence
  Synthetic oligonucleotide
auuucagcaccaaaaauauuccguguu

SEQ ID NO: 12782 - RNA, 27 nt, Artificial Sequence
  Synthetic oligonucleotide
uuucagcaccaaaaauauuccguguug

SEQ ID NO: 12783 - RNA, 27 nt, Artificial Sequence
  Synthetic oligonucleotide
uucagcaccaaaaauauuccguguugg

SEQ ID NO: 12784 - RNA, 27 nt, Artificial Sequence
  Synthetic oligonucleotide
ucagcaccaaaaauauuccguguugga

SEQ ID NO: 12785 - RNA, 27 nt, Artificial Sequence
  Synthetic oligonucleotide
cagcaccaaaaauauuccguguuggag

SEQ ID NO: 12786 - RNA, 27 nt, Artificial Sequence
  Synthetic oligonucleotide
agcaccaaaaauauuccguguuggagc

SEQ ID NO: 12787 - RNA, 27 nt, Artificial Sequence
  Synthetic oligonucleotide
gcaccaaaaauauuccguguuggagca

SEQ ID NO: 12788 - RNA, 27 nt, Artificial Sequence
  Synthetic oligonucleotide
caccaaaaauauuccguguuggagcau

SEQ ID NO: 12789 - RNA, 27 nt, Artificial Sequence
  Synthetic oligonucleotide
accaaaaauauuccguguuggagcauc

SEQ ID NO: 12790 - RNA, 27 nt, Artificial Sequence
  Synthetic oligonucleotide
ccaaaaauauuccguguuggagcaucu

SEQ ID NO: 12791 - RNA, 27 nt, Artificial Sequence
  Synthetic oligonucleotide
caaaaauauuccguguuggagcaucug

SEQ ID NO: 12792 - RNA, 27 nt, Artificial Sequence
  Synthetic oligonucleotide
aaaaauauuccguguuggagcaucuga

SEQ ID NO: 12793 - RNA, 27 nt, Artificial Sequence
  Synthetic oligonucleotide
aaaauauuccguguuggagcaucugaa

SEQ ID NO: 12794 - RNA, 27 nt, Artificial Sequence
  Synthetic oligonucleotide
aaauauuccguguuggagcaucugaaa

SEQ ID NO: 12795 - RNA, 27 nt, Artificial Sequence
  Synthetic oligonucleotide
aauauuccguguuggagcaucugaaaa

SEQ ID NO: 12796 - RNA, 27 nt, Artificial Sequence
  Synthetic oligonucleotide
auauuccguguuggagcaucugaaaau

SEQ ID NO: 12797 - RNA, 27 nt, Artificial Sequence
  Synthetic oligonucleotide
uauuccguguuggagcaucugaaaaua

SEQ ID NO: 12798 - RNA, 27 nt, Artificial Sequence
  Synthetic oligonucleotide
auuccguguuggagcaucugaaaauau

SEQ ID NO: 12799 - RNA, 27 nt, Artificial Sequence
  Synthetic oligonucleotide
uuccguguuggagcaucugaaaauauu

SEQ ID NO: 12800 - RNA, 27 nt, Artificial Sequence
  Synthetic oligonucleotide
uccguguuggagcaucugaaaauauug

SEQ ID NO: 12801 - RNA, 27 nt, Artificial Sequence
  Synthetic oligonucleotide
ccguguuggagcaucugaaaauauugu

SEQ ID NO: 12802 - RNA, 27 nt, Artificial Sequence
  Synthetic oligonucleotide
aaguuuauggauacacugaagcauuug

SEQ ID NO: 12803 - RNA, 27 nt, Artificial Sequence
  Synthetic oligonucleotide
uuuauggauacacugaagcauuugaug

SEQ ID NO: 12804 - RNA, 27 nt, Artificial Sequence
  Synthetic oligonucleotide
uauggauacacugaagcauuugaugca

SEQ ID NO: 12805 - RNA, 27 nt, Artificial Sequence
  Synthetic oligonucleotide
acugaagcauuugaugcaacaaucucu

SEQ ID NO: 12806 - RNA, 27 nt, Artificial Sequence
  Synthetic oligonucleotide
ugaagcauuugaugcaacaaucucuau

SEQ ID NO: 12807 - RNA, 27 nt, Artificial Sequence
  Synthetic oligonucleotide
aagcauuugaugcaacaaucucuauua

SEQ ID NO: 12808 - RNA, 27 nt, Artificial Sequence
  Synthetic oligonucleotide
gcauuugaugcaacaaucucuauuaaa

SEQ ID NO: 12809 - RNA, 27 nt, Artificial Sequence
  Synthetic oligonucleotide
cauuugaugcaacaaucucuauuaaaa

SEQ ID NO: 12810 - RNA, 27 nt, Artificial Sequence
  Synthetic oligonucleotide
auuugaugcaacaaucucuauuaaaag

SEQ ID NO: 12811 - RNA, 27 nt, Artificial Sequence
  Synthetic oligonucleotide
augcaacaaucucuauuaaaaguuauc

SEQ ID NO: 12812 - RNA, 27 nt, Artificial Sequence
  Synthetic oligonucleotide
ugcaacaaucucuauuaaaaguuaucc

SEQ ID NO: 12813 - RNA, 27 nt, Artificial Sequence
  Synthetic oligonucleotide
gcaacaaucucuauuaaaaguuauccu

SEQ ID NO: 12814 - RNA, 27 nt, Artificial Sequence
  Synthetic oligonucleotide
acaaucucuauuaaaaguuauccugau

SEQ ID NO: 12815 - RNA, 27 nt, Artificial Sequence
  Synthetic oligonucleotide
caaucucuauuaaaaguuauccugaua

SEQ ID NO: 12816 - RNA, 27 nt, Artificial Sequence
  Synthetic oligonucleotide
aaucucuauuaaaaguuauccugauaa

SEQ ID NO: 12817 - RNA, 27 nt, Artificial Sequence
  Synthetic oligonucleotide
aucucuauuaaaaguuauccugauaaa

SEQ ID NO: 12818 - RNA, 27 nt, Artificial Sequence
  Synthetic oligonucleotide
ucucuauuaaaaguuauccugauaaaa

SEQ ID NO: 12819 - RNA, 27 nt, Artificial Sequence
  Synthetic oligonucleotide
ucuauuaaaaguuauccugauaaaaaa

SEQ ID NO: 12820 - RNA, 27 nt, Artificial Sequence
  Synthetic oligonucleotide
uauuaaaaguuauccugauaaaaaauu

SEQ ID NO: 12821 - RNA, 27 nt, Artificial Sequence
  Synthetic oligonucleotide
auuaaaaguuauccugauaaaaaauuu

SEQ ID NO: 12822 - RNA, 27 nt, Artificial Sequence
  Synthetic oligonucleotide
aaaaguuauccugauaaaaaauuuagu

SEQ ID NO: 12823 - RNA, 27 nt, Artificial Sequence
  Synthetic oligonucleotide
aaaguuauccugauaaaaaauuuaguu

SEQ ID NO: 12824 - RNA, 27 nt, Artificial Sequence
  Synthetic oligonucleotide
guuauccugauaaaaaauuuaguuacu

SEQ ID NO: 12825 - RNA, 27 nt, Artificial Sequence
  Synthetic oligonucleotide
uuauccugauaaaaaauuuaguuacuc

SEQ ID NO: 12826 - RNA, 27 nt, Artificial Sequence
  Synthetic oligonucleotide
uauccugauaaaaaauuuaguuacucc

SEQ ID NO: 12827 - RNA, 27 nt, Artificial Sequence
  Synthetic oligonucleotide
auccugauaaaaaauuuaguuacuccu

SEQ ID NO: 12828 - RNA, 27 nt, Artificial Sequence
  Synthetic oligonucleotide
uccugauaaaaaauuuaguuacuccuc

SEQ ID NO: 12829 - RNA, 27 nt, Artificial Sequence
  Synthetic oligonucleotide
ccugauaaaaaauuuaguuacuccuca

SEQ ID NO: 12830 - RNA, 27 nt, Artificial Sequence
  Synthetic oligonucleotide
cugauaaaaaauuuaguuacuccucag

SEQ ID NO: 12831 - RNA, 27 nt, Artificial Sequence
  Synthetic oligonucleotide
ugauaaaaaauuuaguuacuccucagg

SEQ ID NO: 12832 - RNA, 27 nt, Artificial Sequence
  Synthetic oligonucleotide
gauaaaaaauuuaguuacuccucaggc

SEQ ID NO: 12833 - RNA, 27 nt, Artificial Sequence
  Synthetic oligonucleotide
auaaaaaauuuaguuacuccucaggcc

SEQ ID NO: 12834 - RNA, 27 nt, Artificial Sequence
  Synthetic oligonucleotide
uaaaaaauuuaguuacuccucaggcca

SEQ ID NO: 12835 - RNA, 27 nt, Artificial Sequence
  Synthetic oligonucleotide
aaaaaauuuaguuacuccucaggccau

SEQ ID NO: 12836 - RNA, 27 nt, Artificial Sequence
  Synthetic oligonucleotide
aaaaauuuaguuacuccucaggccaug

SEQ ID NO: 12837 - RNA, 27 nt, Artificial Sequence
  Synthetic oligonucleotide
aaaauuuaguuacuccucaggccaugu

SEQ ID NO: 12838 - RNA, 27 nt, Artificial Sequence
  Synthetic oligonucleotide
aaauuuaguuacuccucaggccauguu

SEQ ID NO: 12839 - RNA, 27 nt, Artificial Sequence
  Synthetic oligonucleotide
aauuuaguuacuccucaggccauguuc

SEQ ID NO: 12840 - RNA, 27 nt, Artificial Sequence
  Synthetic oligonucleotide
auuuaguuacuccucaggccauguuca

SEQ ID NO: 12841 - RNA, 27 nt, Artificial Sequence
  Synthetic oligonucleotide
uuuaguuacuccucaggccauguucau

SEQ ID NO: 12842 - RNA, 27 nt, Artificial Sequence
  Synthetic oligonucleotide
uuaguuacuccucaggccauguucauu

SEQ ID NO: 12843 - RNA, 27 nt, Artificial Sequence
  Synthetic oligonucleotide
uaguuacuccucaggccauguucauuu

SEQ ID NO: 12844 - RNA, 27 nt, Artificial Sequence
  Synthetic oligonucleotide
aguuacuccucaggccauguucauuua

SEQ ID NO: 12845 - RNA, 27 nt, Artificial Sequence
  Synthetic oligonucleotide
guuacuccucaggccauguucauuuau

SEQ ID NO: 12846 - RNA, 27 nt, Artificial Sequence
  Synthetic oligonucleotide
uuacuccucaggccauguucauuuauc

SEQ ID NO: 12847 - RNA, 27 nt, Artificial Sequence
  Synthetic oligonucleotide
uacuccucaggccauguucauuuaucc

SEQ ID NO: 12848 - RNA, 27 nt, Artificial Sequence
  Synthetic oligonucleotide
acuccucaggccauguucauuuauccu

SEQ ID NO: 12849 - RNA, 27 nt, Artificial Sequence
  Synthetic oligonucleotide
cuccucaggccauguucauuuauccuc

SEQ ID NO: 12850 - RNA, 27 nt, Artificial Sequence
  Synthetic oligonucleotide
uccucaggccauguucauuuauccuca

SEQ ID NO: 12851 - RNA, 27 nt, Artificial Sequence
  Synthetic oligonucleotide
ccucaggccauguucauuuauccucag

SEQ ID NO: 12852 - RNA, 27 nt, Artificial Sequence
  Synthetic oligonucleotide
cucaggccauguucauuuauccucaga

SEQ ID NO: 12853 - RNA, 27 nt, Artificial Sequence
  Synthetic oligonucleotide
ucaggccauguucauuuauccucagag

SEQ ID NO: 12854 - RNA, 27 nt, Artificial Sequence
  Synthetic oligonucleotide
caggccauguucauuuauccucagaga

SEQ ID NO: 12855 - RNA, 27 nt, Artificial Sequence
  Synthetic oligonucleotide
aggccauguucauuuauccucagagaa

SEQ ID NO: 12856 - RNA, 27 nt, Artificial Sequence
  Synthetic oligonucleotide
ggccauguucauuuauccucagagaau

SEQ ID NO: 12857 - RNA, 27 nt, Artificial Sequence
  Synthetic oligonucleotide
gccauguucauuuauccucagagaaua

SEQ ID NO: 12858 - RNA, 27 nt, Artificial Sequence
  Synthetic oligonucleotide
ccauguucauuuauccucagagaauaa

SEQ ID NO: 12859 - RNA, 27 nt, Artificial Sequence
  Synthetic oligonucleotide
cauguucauuuauccucagagaauaaa

SEQ ID NO: 12860 - RNA, 27 nt, Artificial Sequence
  Synthetic oligonucleotide
guucauuuauccucagagaauaaauuc

SEQ ID NO: 12861 - RNA, 27 nt, Artificial Sequence
  Synthetic oligonucleotide
uucauuuauccucagagaauaaauucc

SEQ ID NO: 12862 - RNA, 27 nt, Artificial Sequence
  Synthetic oligonucleotide
ucauuuauccucagagaauaaauucca

SEQ ID NO: 12863 - RNA, 27 nt, Artificial Sequence
  Synthetic oligonucleotide
cauuuauccucagagaauaaauuccaa

SEQ ID NO: 12864 - RNA, 27 nt, Artificial Sequence
  Synthetic oligonucleotide
auuuauccucagagaauaaauuccaaa

SEQ ID NO: 12865 - RNA, 27 nt, Artificial Sequence
  Synthetic oligonucleotide
uuuauccucagagaauaaauuccaaaa

SEQ ID NO: 12866 - RNA, 27 nt, Artificial Sequence
  Synthetic oligonucleotide
uuauccucagagaauaaauuccaaaac

SEQ ID NO: 12867 - RNA, 27 nt, Artificial Sequence
  Synthetic oligonucleotide
uauccucagagaauaaauuccaaaacu

SEQ ID NO: 12868 - RNA, 27 nt, Artificial Sequence
  Synthetic oligonucleotide
auccucagagaauaaauuccaaaacuc

SEQ ID NO: 12869 - RNA, 27 nt, Artificial Sequence
  Synthetic oligonucleotide
uccucagagaauaaauuccaaaacucu

SEQ ID NO: 12870 - RNA, 27 nt, Artificial Sequence
  Synthetic oligonucleotide
ccucagagaauaaauuccaaaacucug

SEQ ID NO: 12871 - RNA, 27 nt, Artificial Sequence
  Synthetic oligonucleotide
cucagagaauaaauuccaaaacucugc

SEQ ID NO: 12872 - RNA, 27 nt, Artificial Sequence
  Synthetic oligonucleotide
ucagagaauaaauuccaaaacucugca

SEQ ID NO: 12873 - RNA, 27 nt, Artificial Sequence
  Synthetic oligonucleotide
cagagaauaaauuccaaaacucugcaa

SEQ ID NO: 12874 - RNA, 27 nt, Artificial Sequence
  Synthetic oligonucleotide
agagaauaaauuccaaaacucugcaau

SEQ ID NO: 12875 - RNA, 27 nt, Artificial Sequence
  Synthetic oligonucleotide
aaucuuaacaauacaaccaaaacaauu

SEQ ID NO: 12876 - RNA, 27 nt, Artificial Sequence
  Synthetic oligonucleotide
aucuuaacaauacaaccaaaacaauug

SEQ ID NO: 12877 - RNA, 27 nt, Artificial Sequence
  Synthetic oligonucleotide
ucuuaacaauacaaccaaaacaauugc

SEQ ID NO: 12878 - RNA, 27 nt, Artificial Sequence
  Synthetic oligonucleotide
cuuaacaauacaaccaaaacaauugcc

SEQ ID NO: 12879 - RNA, 27 nt, Artificial Sequence
  Synthetic oligonucleotide
uuaacaauacaaccaaaacaauugccu

SEQ ID NO: 12880 - RNA, 27 nt, Artificial Sequence
  Synthetic oligonucleotide
uaacaauacaaccaaaacaauugccug

SEQ ID NO: 12881 - RNA, 27 nt, Artificial Sequence
  Synthetic oligonucleotide
aacaauacaaccaaaacaauugccugg

SEQ ID NO: 12882 - RNA, 27 nt, Artificial Sequence
  Synthetic oligonucleotide
guauuuggaaguuguaucaaagcauuu

SEQ ID NO: 12883 - RNA, 27 nt, Artificial Sequence
  Synthetic oligonucleotide
uauuuggaaguuguaucaaagcauuuu

SEQ ID NO: 12884 - RNA, 27 nt, Artificial Sequence
  Synthetic oligonucleotide
uguaucaaagcauuuuucaaaaucaaa

SEQ ID NO: 12885 - RNA, 27 nt, Artificial Sequence
  Synthetic oligonucleotide
guaucaaagcauuuuucaaaaucaaaa

SEQ ID NO: 12886 - RNA, 27 nt, Artificial Sequence
  Synthetic oligonucleotide
uaucaaagcauuuuucaaaaucaaaaa

SEQ ID NO: 12887 - RNA, 27 nt, Artificial Sequence
  Synthetic oligonucleotide
aucaaagcauuuuucaaaaucaaaaag

SEQ ID NO: 12888 - RNA, 27 nt, Artificial Sequence
  Synthetic oligonucleotide
ucaaagcauuuuucaaaaucaaaaaga

SEQ ID NO: 12889 - RNA, 27 nt, Artificial Sequence
  Synthetic oligonucleotide
ugccaauaaccuaugacaauggauuuc

SEQ ID NO: 12890 - RNA, 27 nt, Artificial Sequence
  Synthetic oligonucleotide
gccaauaaccuaugacaauggauuucu

SEQ ID NO: 12891 - RNA, 27 nt, Artificial Sequence
  Synthetic oligonucleotide
caauaaccuaugacaauggauuucucu

SEQ ID NO: 12892 - RNA, 27 nt, Artificial Sequence
  Synthetic oligonucleotide
aauaaccuaugacaauggauuucucuu

SEQ ID NO: 12893 - RNA, 27 nt, Artificial Sequence
  Synthetic oligonucleotide
auaaccuaugacaauggauuucucuuc

SEQ ID NO: 12894 - RNA, 27 nt, Artificial Sequence
  Synthetic oligonucleotide
uaaccuaugacaauggauuucucuuca

SEQ ID NO: 12895 - RNA, 27 nt, Artificial Sequence
  Synthetic oligonucleotide
aaccuaugacaauggauuucucuucau

SEQ ID NO: 12896 - RNA, 27 nt, Artificial Sequence
  Synthetic oligonucleotide
ccuaugacaauggauuucucuucauuc

SEQ ID NO: 12897 - RNA, 27 nt, Artificial Sequence
  Synthetic oligonucleotide
cuaugacaauggauuucucuucauuca

SEQ ID NO: 12898 - RNA, 27 nt, Artificial Sequence
  Synthetic oligonucleotide
uaugacaauggauuucucuucauucau

SEQ ID NO: 12899 - RNA, 27 nt, Artificial Sequence
  Synthetic oligonucleotide
acaauggauuucucuucauucauacag

SEQ ID NO: 12900 - RNA, 27 nt, Artificial Sequence
  Synthetic oligonucleotide
auggauuucucuucauucauacagaca

SEQ ID NO: 12901 - RNA, 27 nt, Artificial Sequence
  Synthetic oligonucleotide
ggauuucucuucauucauacagacaaa

SEQ ID NO: 12902 - RNA, 27 nt, Artificial Sequence
  Synthetic oligonucleotide
gauuucucuucauucauacagacaaac

SEQ ID NO: 12903 - RNA, 27 nt, Artificial Sequence
  Synthetic oligonucleotide
auuucucuucauucauacagacaaacc

SEQ ID NO: 12904 - RNA, 27 nt, Artificial Sequence
  Synthetic oligonucleotide
uuucucuucauucauacagacaaaccu

SEQ ID NO: 12905 - RNA, 27 nt, Artificial Sequence
  Synthetic oligonucleotide
uucucuucauucauacagacaaaccug

SEQ ID NO: 12906 - RNA, 27 nt, Artificial Sequence
  Synthetic oligonucleotide
ucucuucauucauacagacaaaccugu

SEQ ID NO: 12907 - RNA, 27 nt, Artificial Sequence
  Synthetic oligonucleotide
cucuucauucauacagacaaaccuguu

SEQ ID NO: 12908 - RNA, 27 nt, Artificial Sequence
  Synthetic oligonucleotide
ucuucauucauacagacaaaccuguuu

SEQ ID NO: 12909 - RNA, 27 nt, Artificial Sequence
  Synthetic oligonucleotide
cuucauucauacagacaaaccuguuua

SEQ ID NO: 12910 - RNA, 27 nt, Artificial Sequence
  Synthetic oligonucleotide
uucauucauacagacaaaccuguuuau

SEQ ID NO: 12911 - RNA, 27 nt, Artificial Sequence
  Synthetic oligonucleotide
cauucauacagacaaaccuguuuauac

SEQ ID NO: 12912 - RNA, 27 nt, Artificial Sequence
  Synthetic oligonucleotide
cauacagacaaaccuguuuauacucca

SEQ ID NO: 12913 - RNA, 27 nt, Artificial Sequence
  Synthetic oligonucleotide
auacagacaaaccuguuuauacuccag

SEQ ID NO: 12914 - RNA, 27 nt, Artificial Sequence
  Synthetic oligonucleotide
uacagacaaaccuguuuauacuccaga

SEQ ID NO: 12915 - RNA, 27 nt, Artificial Sequence
  Synthetic oligonucleotide
acagacaaaccuguuuauacuccagac

SEQ ID NO: 12916 - RNA, 27 nt, Artificial Sequence
  Synthetic oligonucleotide
cagacaaaccuguuuauacuccagacc

SEQ ID NO: 12917 - RNA, 27 nt, Artificial Sequence
  Synthetic oligonucleotide
agacaaaccuguuuauacuccagacca

SEQ ID NO: 12918 - RNA, 27 nt, Artificial Sequence
  Synthetic oligonucleotide
gacaaaccuguuuauacuccagaccag

SEQ ID NO: 12919 - RNA, 27 nt, Artificial Sequence
  Synthetic oligonucleotide
acaaaccuguuuauacuccagaccagu

SEQ ID NO: 12920 - RNA, 27 nt, Artificial Sequence
  Synthetic oligonucleotide
caaaccuguuuauacuccagaccaguc

SEQ ID NO: 12921 - RNA, 27 nt, Artificial Sequence
  Synthetic oligonucleotide
aaaccuguuuauacuccagaccaguca

SEQ ID NO: 12922 - RNA, 27 nt, Artificial Sequence
  Synthetic oligonucleotide
aaccuguuuauacuccagaccagucag

SEQ ID NO: 12923 - RNA, 27 nt, Artificial Sequence
  Synthetic oligonucleotide
accuguuuauacuccagaccagucagu

SEQ ID NO: 12924 - RNA, 27 nt, Artificial Sequence
  Synthetic oligonucleotide
aguuagaguuuauucguugaaugacga

SEQ ID NO: 12925 - RNA, 27 nt, Artificial Sequence
  Synthetic oligonucleotide
guuagaguuuauucguugaaugacgac

SEQ ID NO: 12926 - RNA, 27 nt, Artificial Sequence
  Synthetic oligonucleotide
uuagaguuuauucguugaaugacgacu

SEQ ID NO: 12927 - RNA, 27 nt, Artificial Sequence
  Synthetic oligonucleotide
uagaguuuauucguugaaugacgacuu

SEQ ID NO: 12928 - RNA, 27 nt, Artificial Sequence
  Synthetic oligonucleotide
acgacuugaagccagccaaaagagaaa

SEQ ID NO: 12929 - RNA, 27 nt, Artificial Sequence
  Synthetic oligonucleotide
cgacuugaagccagccaaaagagaaac

SEQ ID NO: 12930 - RNA, 27 nt, Artificial Sequence
  Synthetic oligonucleotide
gacuugaagccagccaaaagagaaacu

SEQ ID NO: 12931 - RNA, 27 nt, Artificial Sequence
  Synthetic oligonucleotide
acuugaagccagccaaaagagaaacug

SEQ ID NO: 12932 - RNA, 27 nt, Artificial Sequence
  Synthetic oligonucleotide
cuugaagccagccaaaagagaaacugu

SEQ ID NO: 12933 - RNA, 27 nt, Artificial Sequence
  Synthetic oligonucleotide
uugaagccagccaaaagagaaacuguc

SEQ ID NO: 12934 - RNA, 27 nt, Artificial Sequence
  Synthetic oligonucleotide
ugaagccagccaaaagagaaacugucu

SEQ ID NO: 12935 - RNA, 27 nt, Artificial Sequence
  Synthetic oligonucleotide
gaagccagccaaaagagaaacugucuu

SEQ ID NO: 12936 - RNA, 27 nt, Artificial Sequence
  Synthetic oligonucleotide
aagccagccaaaagagaaacugucuua

SEQ ID NO: 12937 - RNA, 27 nt, Artificial Sequence
  Synthetic oligonucleotide
agccagccaaaagagaaacugucuuaa

SEQ ID NO: 12938 - RNA, 27 nt, Artificial Sequence
  Synthetic oligonucleotide
gccagccaaaagagaaacugucuuaac

SEQ ID NO: 12939 - RNA, 27 nt, Artificial Sequence
  Synthetic oligonucleotide
ccagccaaaagagaaacugucuuaacu

SEQ ID NO: 12940 - RNA, 27 nt, Artificial Sequence
  Synthetic oligonucleotide
cagccaaaagagaaacugucuuaacuu

SEQ ID NO: 12941 - RNA, 27 nt, Artificial Sequence
  Synthetic oligonucleotide
agccaaaagagaaacugucuuaacuuu

SEQ ID NO: 12942 - RNA, 27 nt, Artificial Sequence
  Synthetic oligonucleotide
gccaaaagagaaacugucuuaacuuuc

SEQ ID NO: 12943 - RNA, 27 nt, Artificial Sequence
  Synthetic oligonucleotide
ccaaaagagaaacugucuuaacuuuca

SEQ ID NO: 12944 - RNA, 27 nt, Artificial Sequence
  Synthetic oligonucleotide
caaaagagaaacugucuuaacuuucau

SEQ ID NO: 12945 - RNA, 27 nt, Artificial Sequence
  Synthetic oligonucleotide
aaaagagaaacugucuuaacuuucaua

SEQ ID NO: 12946 - RNA, 27 nt, Artificial Sequence
  Synthetic oligonucleotide
aaagagaaacugucuuaacuuucauag

SEQ ID NO: 12947 - RNA, 27 nt, Artificial Sequence
  Synthetic oligonucleotide
aagagaaacugucuuaacuuucauaga

SEQ ID NO: 12948 - RNA, 27 nt, Artificial Sequence
  Synthetic oligonucleotide
gagaaacugucuuaacuuucauagauc

SEQ ID NO: 12949 - RNA, 27 nt, Artificial Sequence
  Synthetic oligonucleotide
agaaacugucuuaacuuucauagaucc

SEQ ID NO: 12950 - RNA, 27 nt, Artificial Sequence
  Synthetic oligonucleotide
gaaacugucuuaacuuucauagauccu

SEQ ID NO: 12951 - RNA, 27 nt, Artificial Sequence
  Synthetic oligonucleotide
acugucuuaacuuucauagauccugaa

SEQ ID NO: 12952 - RNA, 27 nt, Artificial Sequence
  Synthetic oligonucleotide
cugucuuaacuuucauagauccugaag

SEQ ID NO: 12953 - RNA, 27 nt, Artificial Sequence
  Synthetic oligonucleotide
ugucuuaacuuucauagauccugaagg

SEQ ID NO: 12954 - RNA, 27 nt, Artificial Sequence
  Synthetic oligonucleotide
gucuuaacuuucauagauccugaagga

SEQ ID NO: 12955 - RNA, 27 nt, Artificial Sequence
  Synthetic oligonucleotide
ucuuaacuuucauagauccugaaggau

SEQ ID NO: 12956 - RNA, 27 nt, Artificial Sequence
  Synthetic oligonucleotide
cuuaacuuucauagauccugaaggauc

SEQ ID NO: 12957 - RNA, 27 nt, Artificial Sequence
  Synthetic oligonucleotide
uuaacuuucauagauccugaaggauca

SEQ ID NO: 12958 - RNA, 27 nt, Artificial Sequence
  Synthetic oligonucleotide
uaacuuucauagauccugaaggaucag

SEQ ID NO: 12959 - RNA, 27 nt, Artificial Sequence
  Synthetic oligonucleotide
aacuuucauagauccugaaggaucaga

SEQ ID NO: 12960 - RNA, 27 nt, Artificial Sequence
  Synthetic oligonucleotide
acuuucauagauccugaaggaucagaa

SEQ ID NO: 12961 - RNA, 27 nt, Artificial Sequence
  Synthetic oligonucleotide
cuuucauagauccugaaggaucagaag

SEQ ID NO: 12962 - RNA, 27 nt, Artificial Sequence
  Synthetic oligonucleotide
uuucauagauccugaaggaucagaagu

SEQ ID NO: 12963 - RNA, 27 nt, Artificial Sequence
  Synthetic oligonucleotide
uucauagauccugaaggaucagaaguu

SEQ ID NO: 12964 - RNA, 27 nt, Artificial Sequence
  Synthetic oligonucleotide
ucauagauccugaaggaucagaaguug

SEQ ID NO: 12965 - RNA, 27 nt, Artificial Sequence
  Synthetic oligonucleotide
cauagauccugaaggaucagaaguuga

SEQ ID NO: 12966 - RNA, 27 nt, Artificial Sequence
  Synthetic oligonucleotide
auagauccugaaggaucagaaguugac

SEQ ID NO: 12967 - RNA, 27 nt, Artificial Sequence
  Synthetic oligonucleotide
aguugacaugguagaagaaauugauca

SEQ ID NO: 12968 - RNA, 27 nt, Artificial Sequence
  Synthetic oligonucleotide
guugacaugguagaagaaauugaucau

SEQ ID NO: 12969 - RNA, 27 nt, Artificial Sequence
  Synthetic oligonucleotide
gacaugguagaagaaauugaucauauu

SEQ ID NO: 12970 - RNA, 27 nt, Artificial Sequence
  Synthetic oligonucleotide
acaugguagaagaaauugaucauauug

SEQ ID NO: 12971 - RNA, 27 nt, Artificial Sequence
  Synthetic oligonucleotide
caugguagaagaaauugaucauauugg

SEQ ID NO: 12972 - RNA, 27 nt, Artificial Sequence
  Synthetic oligonucleotide
gguagaagaaauugaucauauuggaau

SEQ ID NO: 12973 - RNA, 27 nt, Artificial Sequence
  Synthetic oligonucleotide
guagaagaaauugaucauauuggaauu

SEQ ID NO: 12974 - RNA, 27 nt, Artificial Sequence
  Synthetic oligonucleotide
uagaagaaauugaucauauuggaauua

SEQ ID NO: 12975 - RNA, 27 nt, Artificial Sequence
  Synthetic oligonucleotide
aagaaauugaucauauuggaauuaucu

SEQ ID NO: 12976 - RNA, 27 nt, Artificial Sequence
  Synthetic oligonucleotide
agaaauugaucauauuggaauuaucuc

SEQ ID NO: 12977 - RNA, 27 nt, Artificial Sequence
  Synthetic oligonucleotide
gaaauugaucauauuggaauuaucucu

SEQ ID NO: 12978 - RNA, 27 nt, Artificial Sequence
  Synthetic oligonucleotide
aaauugaucauauuggaauuaucucuu

SEQ ID NO: 12979 - RNA, 27 nt, Artificial Sequence
  Synthetic oligonucleotide
aauugaucauauuggaauuaucucuuu

SEQ ID NO: 12980 - RNA, 27 nt, Artificial Sequence
  Synthetic oligonucleotide
auugaucauauuggaauuaucucuuuu

SEQ ID NO: 12981 - RNA, 27 nt, Artificial Sequence
  Synthetic oligonucleotide
uugaucauauuggaauuaucucuuuuc

SEQ ID NO: 12982 - RNA, 27 nt, Artificial Sequence
  Synthetic oligonucleotide
ugaucauauuggaauuaucucuuuucc

SEQ ID NO: 12983 - RNA, 27 nt, Artificial Sequence
  Synthetic oligonucleotide
gaucauauuggaauuaucucuuuuccu

SEQ ID NO: 12984 - RNA, 27 nt, Artificial Sequence
  Synthetic oligonucleotide
aucauauuggaauuaucucuuuuccug

SEQ ID NO: 12985 - RNA, 27 nt, Artificial Sequence
  Synthetic oligonucleotide
ucauauuggaauuaucucuuuuccuga

SEQ ID NO: 12986 - RNA, 27 nt, Artificial Sequence
  Synthetic oligonucleotide
cauauuggaauuaucucuuuuccugac

SEQ ID NO: 12987 - RNA, 27 nt, Artificial Sequence
  Synthetic oligonucleotide
auauuggaauuaucucuuuuccugacu

SEQ ID NO: 12988 - RNA, 27 nt, Artificial Sequence
  Synthetic oligonucleotide
uauuggaauuaucucuuuuccugacuu

SEQ ID NO: 12989 - RNA, 27 nt, Artificial Sequence
  Synthetic oligonucleotide
auuggaauuaucucuuuuccugacuuc

SEQ ID NO: 12990 - RNA, 27 nt, Artificial Sequence
  Synthetic oligonucleotide
uuuccugacuucaagauuccgucuaau

SEQ ID NO: 12991 - RNA, 27 nt, Artificial Sequence
  Synthetic oligonucleotide
uuccugacuucaagauuccgucuaauc

SEQ ID NO: 12992 - RNA, 27 nt, Artificial Sequence
  Synthetic oligonucleotide
uccugacuucaagauuccgucuaaucc

SEQ ID NO: 12993 - RNA, 27 nt, Artificial Sequence
  Synthetic oligonucleotide
ccugacuucaagauuccgucuaauccu

SEQ ID NO: 12994 - RNA, 27 nt, Artificial Sequence
  Synthetic oligonucleotide
cugacuucaagauuccgucuaauccua

SEQ ID NO: 12995 - RNA, 27 nt, Artificial Sequence
  Synthetic oligonucleotide
ugacuucaagauuccgucuaauccuag

SEQ ID NO: 12996 - RNA, 27 nt, Artificial Sequence
  Synthetic oligonucleotide
gacuucaagauuccgucuaauccuaga

SEQ ID NO: 12997 - RNA, 27 nt, Artificial Sequence
  Synthetic oligonucleotide
acuucaagauuccgucuaauccuagau

SEQ ID NO: 12998 - RNA, 27 nt, Artificial Sequence
  Synthetic oligonucleotide
cuucaagauuccgucuaauccuagaua

SEQ ID NO: 12999 - RNA, 27 nt, Artificial Sequence
  Synthetic oligonucleotide
uucaagauuccgucuaauccuagauau

SEQ ID NO: 13000 - RNA, 27 nt, Artificial Sequence
  Synthetic oligonucleotide
ucaagauuccgucuaauccuagauaug

SEQ ID NO: 13001 - RNA, 27 nt, Artificial Sequence
  Synthetic oligonucleotide
caagauuccgucuaauccuagauaugg

SEQ ID NO: 13002 - RNA, 27 nt, Artificial Sequence
  Synthetic oligonucleotide
aagauuccgucuaauccuagauauggu

SEQ ID NO: 13003 - RNA, 27 nt, Artificial Sequence
  Synthetic oligonucleotide
agauuccgucuaauccuagauauggua

SEQ ID NO: 13004 - RNA, 27 nt, Artificial Sequence
  Synthetic oligonucleotide
gauuccgucuaauccuagauaugguau

SEQ ID NO: 13005 - RNA, 27 nt, Artificial Sequence
  Synthetic oligonucleotide
auuccgucuaauccuagauaugguaug

SEQ ID NO: 13006 - RNA, 27 nt, Artificial Sequence
  Synthetic oligonucleotide
uuccgucuaauccuagauaugguaugu

SEQ ID NO: 13007 - RNA, 27 nt, Artificial Sequence
  Synthetic oligonucleotide
uccgucuaauccuagauaugguaugug

SEQ ID NO: 13008 - RNA, 27 nt, Artificial Sequence
  Synthetic oligonucleotide
ccgucuaauccuagauaugguaugugg

SEQ ID NO: 13009 - RNA, 27 nt, Artificial Sequence
  Synthetic oligonucleotide
cgucuaauccuagauaugguaugugga

SEQ ID NO: 13010 - RNA, 27 nt, Artificial Sequence
  Synthetic oligonucleotide
gucuaauccuagauaugguauguggac

SEQ ID NO: 13011 - RNA, 27 nt, Artificial Sequence
  Synthetic oligonucleotide
ucuaauccuagauaugguauguggacg

SEQ ID NO: 13012 - RNA, 27 nt, Artificial Sequence
  Synthetic oligonucleotide
cuaauccuagauaugguauguggacga

SEQ ID NO: 13013 - RNA, 27 nt, Artificial Sequence
  Synthetic oligonucleotide
uaauccuagauaugguauguggacgau

SEQ ID NO: 13014 - RNA, 27 nt, Artificial Sequence
  Synthetic oligonucleotide
aauccuagauaugguauguggacgauc

SEQ ID NO: 13015 - RNA, 27 nt, Artificial Sequence
  Synthetic oligonucleotide
auccuagauaugguauguggacgauca

SEQ ID NO: 13016 - RNA, 27 nt, Artificial Sequence
  Synthetic oligonucleotide
caaggcuaaauauaaagaggacuuuuc

SEQ ID NO: 13017 - RNA, 27 nt, Artificial Sequence
  Synthetic oligonucleotide
aaggcuaaauauaaagaggacuuuuca

SEQ ID NO: 13018 - RNA, 27 nt, Artificial Sequence
  Synthetic oligonucleotide
aggcuaaauauaaagaggacuuuucaa

SEQ ID NO: 13019 - RNA, 27 nt, Artificial Sequence
  Synthetic oligonucleotide
ggcuaaauauaaagaggacuuuucaac

SEQ ID NO: 13020 - RNA, 27 nt, Artificial Sequence
  Synthetic oligonucleotide
gcuaaauauaaagaggacuuuucaaca

SEQ ID NO: 13021 - RNA, 27 nt, Artificial Sequence
  Synthetic oligonucleotide
cuaaauauaaagaggacuuuucaacaa

SEQ ID NO: 13022 - RNA, 27 nt, Artificial Sequence
  Synthetic oligonucleotide
uaaauauaaagaggacuuuucaacaac

SEQ ID NO: 13023 - RNA, 27 nt, Artificial Sequence
  Synthetic oligonucleotide
aaauauaaagaggacuuuucaacaacu

SEQ ID NO: 13024 - RNA, 27 nt, Artificial Sequence
  Synthetic oligonucleotide
aauauaaagaggacuuuucaacaacug

SEQ ID NO: 13025 - RNA, 27 nt, Artificial Sequence
  Synthetic oligonucleotide
auauaaagaggacuuuucaacaacugg

SEQ ID NO: 13026 - RNA, 27 nt, Artificial Sequence
  Synthetic oligonucleotide
uauaaagaggacuuuucaacaacugga

SEQ ID NO: 13027 - RNA, 27 nt, Artificial Sequence
  Synthetic oligonucleotide
auaaagaggacuuuucaacaacuggaa

SEQ ID NO: 13028 - RNA, 27 nt, Artificial Sequence
  Synthetic oligonucleotide
uaaagaggacuuuucaacaacuggaac

SEQ ID NO: 13029 - RNA, 27 nt, Artificial Sequence
  Synthetic oligonucleotide
aaagaggacuuuucaacaacuggaacc

SEQ ID NO: 13030 - RNA, 27 nt, Artificial Sequence
  Synthetic oligonucleotide
aagaggacuuuucaacaacuggaaccg

SEQ ID NO: 13031 - RNA, 27 nt, Artificial Sequence
  Synthetic oligonucleotide
agaggacuuuucaacaacuggaaccgc

SEQ ID NO: 13032 - RNA, 27 nt, Artificial Sequence
  Synthetic oligonucleotide
gaggacuuuucaacaacuggaaccgca

SEQ ID NO: 13033 - RNA, 27 nt, Artificial Sequence
  Synthetic oligonucleotide
aggacuuuucaacaacuggaaccgcau

SEQ ID NO: 13034 - RNA, 27 nt, Artificial Sequence
  Synthetic oligonucleotide
ggacuuuucaacaacuggaaccgcaua

SEQ ID NO: 13035 - RNA, 27 nt, Artificial Sequence
  Synthetic oligonucleotide
uauuuugaaguuaaagaauaugucuug

SEQ ID NO: 13036 - RNA, 27 nt, Artificial Sequence
  Synthetic oligonucleotide
auuuugaaguuaaagaauaugucuugc

SEQ ID NO: 13037 - RNA, 27 nt, Artificial Sequence
  Synthetic oligonucleotide
uuuugaaguuaaagaauaugucuugcc

SEQ ID NO: 13038 - RNA, 27 nt, Artificial Sequence
  Synthetic oligonucleotide
uuugaaguuaaagaauaugucuugcca

SEQ ID NO: 13039 - RNA, 27 nt, Artificial Sequence
  Synthetic oligonucleotide
uugaaguuaaagaauaugucuugccac

SEQ ID NO: 13040 - RNA, 27 nt, Artificial Sequence
  Synthetic oligonucleotide
ugaaguuaaagaauaugucuugccaca

SEQ ID NO: 13041 - RNA, 27 nt, Artificial Sequence
  Synthetic oligonucleotide
gaaguuaaagaauaugucuugccacau

SEQ ID NO: 13042 - RNA, 27 nt, Artificial Sequence
  Synthetic oligonucleotide
aaguuaaagaauaugucuugccacauu

SEQ ID NO: 13043 - RNA, 27 nt, Artificial Sequence
  Synthetic oligonucleotide
uaaagaauaugucuugccacauuuuuc

SEQ ID NO: 13044 - RNA, 27 nt, Artificial Sequence
  Synthetic oligonucleotide
aaagaauaugucuugccacauuuuucu

SEQ ID NO: 13045 - RNA, 27 nt, Artificial Sequence
  Synthetic oligonucleotide
aagaauaugucuugccacauuuuucug

SEQ ID NO: 13046 - RNA, 27 nt, Artificial Sequence
  Synthetic oligonucleotide
agaauaugucuugccacauuuuucugu

SEQ ID NO: 13047 - RNA, 27 nt, Artificial Sequence
  Synthetic oligonucleotide
gaauaugucuugccacauuuuucuguc

SEQ ID NO: 13048 - RNA, 27 nt, Artificial Sequence
  Synthetic oligonucleotide
aauaugucuugccacauuuuucugucu

SEQ ID NO: 13049 - RNA, 27 nt, Artificial Sequence
  Synthetic oligonucleotide
auaugucuugccacauuuuucugucuc

SEQ ID NO: 13050 - RNA, 27 nt, Artificial Sequence
  Synthetic oligonucleotide
uaugucuugccacauuuuucugucuca

SEQ ID NO: 13051 - RNA, 27 nt, Artificial Sequence
  Synthetic oligonucleotide
augucuugccacauuuuucugucucaa

SEQ ID NO: 13052 - RNA, 27 nt, Artificial Sequence
  Synthetic oligonucleotide
ugucuugccacauuuuucugucucaau

SEQ ID NO: 13053 - RNA, 27 nt, Artificial Sequence
  Synthetic oligonucleotide
gucuugccacauuuuucugucucaauc

SEQ ID NO: 13054 - RNA, 27 nt, Artificial Sequence
  Synthetic oligonucleotide
ucuugccacauuuuucugucucaaucg

SEQ ID NO: 13055 - RNA, 27 nt, Artificial Sequence
  Synthetic oligonucleotide
cuugccacauuuuucugucucaaucga

SEQ ID NO: 13056 - RNA, 27 nt, Artificial Sequence
  Synthetic oligonucleotide
uugccacauuuuucugucucaaucgag

SEQ ID NO: 13057 - RNA, 27 nt, Artificial Sequence
  Synthetic oligonucleotide
aagaacuuuaagaauuuugaaauuacu

SEQ ID NO: 13058 - RNA, 27 nt, Artificial Sequence
  Synthetic oligonucleotide
agaacuuuaagaauuuugaaauuacua

SEQ ID NO: 13059 - RNA, 27 nt, Artificial Sequence
  Synthetic oligonucleotide
gaacuuuaagaauuuugaaauuacuau

SEQ ID NO: 13060 - RNA, 27 nt, Artificial Sequence
  Synthetic oligonucleotide
acuuuaagaauuuugaaauuacuauaa

SEQ ID NO: 13061 - RNA, 27 nt, Artificial Sequence
  Synthetic oligonucleotide
cuuuaagaauuuugaaauuacuauaaa

SEQ ID NO: 13062 - RNA, 27 nt, Artificial Sequence
  Synthetic oligonucleotide
uuuaagaauuuugaaauuacuauaaaa

SEQ ID NO: 13063 - RNA, 27 nt, Artificial Sequence
  Synthetic oligonucleotide
uuaagaauuuugaaauuacuauaaaag

SEQ ID NO: 13064 - RNA, 27 nt, Artificial Sequence
  Synthetic oligonucleotide
uaagaauuuugaaauuacuauaaaagc

SEQ ID NO: 13065 - RNA, 27 nt, Artificial Sequence
  Synthetic oligonucleotide
aauuuugaaauuacuauaaaagcaaga

SEQ ID NO: 13066 - RNA, 27 nt, Artificial Sequence
  Synthetic oligonucleotide
auuuugaaauuacuauaaaagcaagau

SEQ ID NO: 13067 - RNA, 27 nt, Artificial Sequence
  Synthetic oligonucleotide
ugaaauuacuauaaaagcaagauauuu

SEQ ID NO: 13068 - RNA, 27 nt, Artificial Sequence
  Synthetic oligonucleotide
gaaauuacuauaaaagcaagauauuuu

SEQ ID NO: 13069 - RNA, 27 nt, Artificial Sequence
  Synthetic oligonucleotide
aaauuacuauaaaagcaagauauuuuu

SEQ ID NO: 13070 - RNA, 27 nt, Artificial Sequence
  Synthetic oligonucleotide
aauuacuauaaaagcaagauauuuuua

SEQ ID NO: 13071 - RNA, 27 nt, Artificial Sequence
  Synthetic oligonucleotide
auuacuauaaaagcaagauauuuuuau

SEQ ID NO: 13072 - RNA, 27 nt, Artificial Sequence
  Synthetic oligonucleotide
uuacuauaaaagcaagauauuuuuaua

SEQ ID NO: 13073 - RNA, 27 nt, Artificial Sequence
  Synthetic oligonucleotide
uacuauaaaagcaagauauuuuuauaa

SEQ ID NO: 13074 - RNA, 27 nt, Artificial Sequence
  Synthetic oligonucleotide
acuauaaaagcaagauauuuuuauaau

SEQ ID NO: 13075 - RNA, 27 nt, Artificial Sequence
  Synthetic oligonucleotide
cuauaaaagcaagauauuuuuauaaua

SEQ ID NO: 13076 - RNA, 27 nt, Artificial Sequence
  Synthetic oligonucleotide
uauaaaagcaagauauuuuuauaauaa

SEQ ID NO: 13077 - RNA, 27 nt, Artificial Sequence
  Synthetic oligonucleotide
auaaaagcaagauauuuuuauaauaaa

SEQ ID NO: 13078 - RNA, 27 nt, Artificial Sequence
  Synthetic oligonucleotide
agauauuuuuauaauaaaguagucacu

SEQ ID NO: 13079 - RNA, 27 nt, Artificial Sequence
  Synthetic oligonucleotide
gauauuuuuauaauaaaguagucacug

SEQ ID NO: 13080 - RNA, 27 nt, Artificial Sequence
  Synthetic oligonucleotide
auauuuuuauaauaaaguagucacuga

SEQ ID NO: 13081 - RNA, 27 nt, Artificial Sequence
  Synthetic oligonucleotide
uauuuuuauaauaaaguagucacugag

SEQ ID NO: 13082 - RNA, 27 nt, Artificial Sequence
  Synthetic oligonucleotide
auuuuuauaauaaaguagucacugagg

SEQ ID NO: 13083 - RNA, 27 nt, Artificial Sequence
  Synthetic oligonucleotide
uuuuuauaauaaaguagucacugaggc

SEQ ID NO: 13084 - RNA, 27 nt, Artificial Sequence
  Synthetic oligonucleotide
uuuuauaauaaaguagucacugaggcu

SEQ ID NO: 13085 - RNA, 27 nt, Artificial Sequence
  Synthetic oligonucleotide
uuuauaauaaaguagucacugaggcug

SEQ ID NO: 13086 - RNA, 27 nt, Artificial Sequence
  Synthetic oligonucleotide
uuauaauaaaguagucacugaggcuga

SEQ ID NO: 13087 - RNA, 27 nt, Artificial Sequence
  Synthetic oligonucleotide
uauaauaaaguagucacugaggcugac

SEQ ID NO: 13088 - RNA, 27 nt, Artificial Sequence
  Synthetic oligonucleotide
auaauaaaguagucacugaggcugacg

SEQ ID NO: 13089 - RNA, 27 nt, Artificial Sequence
  Synthetic oligonucleotide
uaauaaaguagucacugaggcugacgu

SEQ ID NO: 13090 - RNA, 27 nt, Artificial Sequence
  Synthetic oligonucleotide
aauaaaguagucacugaggcugacguu

SEQ ID NO: 13091 - RNA, 27 nt, Artificial Sequence
  Synthetic oligonucleotide
auaaaguagucacugaggcugacguuu

SEQ ID NO: 13092 - RNA, 27 nt, Artificial Sequence
  Synthetic oligonucleotide
uaaaguagucacugaggcugacguuua

SEQ ID NO: 13093 - RNA, 27 nt, Artificial Sequence
  Synthetic oligonucleotide
acguuuauaucacauuuggaauaagag

SEQ ID NO: 13094 - RNA, 27 nt, Artificial Sequence
  Synthetic oligonucleotide
cguuuauaucacauuuggaauaagaga

SEQ ID NO: 13095 - RNA, 27 nt, Artificial Sequence
  Synthetic oligonucleotide
guuuauaucacauuuggaauaagagaa

SEQ ID NO: 13096 - RNA, 27 nt, Artificial Sequence
  Synthetic oligonucleotide
uuuauaucacauuuggaauaagagaag

SEQ ID NO: 13097 - RNA, 27 nt, Artificial Sequence
  Synthetic oligonucleotide
uuauaucacauuuggaauaagagaaga

SEQ ID NO: 13098 - RNA, 27 nt, Artificial Sequence
  Synthetic oligonucleotide
uauaucacauuuggaauaagagaagac

SEQ ID NO: 13099 - RNA, 27 nt, Artificial Sequence
  Synthetic oligonucleotide
auaucacauuuggaauaagagaagacu

SEQ ID NO: 13100 - RNA, 27 nt, Artificial Sequence
  Synthetic oligonucleotide
uaucacauuuggaauaagagaagacuu

SEQ ID NO: 13101 - RNA, 27 nt, Artificial Sequence
  Synthetic oligonucleotide
aucacauuuggaauaagagaagacuua

SEQ ID NO: 13102 - RNA, 27 nt, Artificial Sequence
  Synthetic oligonucleotide
ucacauuuggaauaagagaagacuuaa

SEQ ID NO: 13103 - RNA, 27 nt, Artificial Sequence
  Synthetic oligonucleotide
cacauuuggaauaagagaagacuuaaa

SEQ ID NO: 13104 - RNA, 27 nt, Artificial Sequence
  Synthetic oligonucleotide
acauuuggaauaagagaagacuuaaaa

SEQ ID NO: 13105 - RNA, 27 nt, Artificial Sequence
  Synthetic oligonucleotide
cauuuggaauaagagaagacuuaaaag

SEQ ID NO: 13106 - RNA, 27 nt, Artificial Sequence
  Synthetic oligonucleotide
auuuggaauaagagaagacuuaaaaga

SEQ ID NO: 13107 - RNA, 27 nt, Artificial Sequence
  Synthetic oligonucleotide
uuuggaauaagagaagacuuaaaagau

SEQ ID NO: 13108 - RNA, 27 nt, Artificial Sequence
  Synthetic oligonucleotide
uuggaauaagagaagacuuaaaagaug

SEQ ID NO: 13109 - RNA, 27 nt, Artificial Sequence
  Synthetic oligonucleotide
uggaauaagagaagacuuaaaagauga

SEQ ID NO: 13110 - RNA, 27 nt, Artificial Sequence
  Synthetic oligonucleotide
ggaauaagagaagacuuaaaagaugau

SEQ ID NO: 13111 - RNA, 27 nt, Artificial Sequence
  Synthetic oligonucleotide
gaauaagagaagacuuaaaagaugauc

SEQ ID NO: 13112 - RNA, 27 nt, Artificial Sequence
  Synthetic oligonucleotide
aauaagagaagacuuaaaagaugauca

SEQ ID NO: 13113 - RNA, 27 nt, Artificial Sequence
  Synthetic oligonucleotide
auaagagaagacuuaaaagaugaucaa

SEQ ID NO: 13114 - RNA, 27 nt, Artificial Sequence
  Synthetic oligonucleotide
uaagagaagacuuaaaagaugaucaaa

SEQ ID NO: 13115 - RNA, 27 nt, Artificial Sequence
  Synthetic oligonucleotide
aagagaagacuuaaaagaugaucaaaa

SEQ ID NO: 13116 - RNA, 27 nt, Artificial Sequence
  Synthetic oligonucleotide
agagaagacuuaaaagaugaucaaaaa

SEQ ID NO: 13117 - RNA, 27 nt, Artificial Sequence
  Synthetic oligonucleotide
gagaagacuuaaaagaugaucaaaaag

SEQ ID NO: 13118 - RNA, 27 nt, Artificial Sequence
  Synthetic oligonucleotide
agaagacuuaaaagaugaucaaaaaga

SEQ ID NO: 13119 - RNA, 27 nt, Artificial Sequence
  Synthetic oligonucleotide
gaagacuuaaaagaugaucaaaaagaa

SEQ ID NO: 13120 - RNA, 27 nt, Artificial Sequence
  Synthetic oligonucleotide
aagacuuaaaagaugaucaaaaagaaa

SEQ ID NO: 13121 - RNA, 27 nt, Artificial Sequence
  Synthetic oligonucleotide
agacuuaaaagaugaucaaaaagaaau

SEQ ID NO: 13122 - RNA, 27 nt, Artificial Sequence
  Synthetic oligonucleotide
gacuuaaaagaugaucaaaaagaaaug

SEQ ID NO: 13123 - RNA, 27 nt, Artificial Sequence
  Synthetic oligonucleotide
acuuaaaagaugaucaaaaagaaauga

SEQ ID NO: 13124 - RNA, 27 nt, Artificial Sequence
  Synthetic oligonucleotide
cuuaaaagaugaucaaaaagaaaugau

SEQ ID NO: 13125 - RNA, 27 nt, Artificial Sequence
  Synthetic oligonucleotide
uuaaaagaugaucaaaaagaaaugaug

SEQ ID NO: 13126 - RNA, 27 nt, Artificial Sequence
  Synthetic oligonucleotide
uaaaagaugaucaaaaagaaaugaugc

SEQ ID NO: 13127 - RNA, 27 nt, Artificial Sequence
  Synthetic oligonucleotide
aaaagaugaucaaaaagaaaugaugca

SEQ ID NO: 13128 - RNA, 27 nt, Artificial Sequence
  Synthetic oligonucleotide
aaagaugaucaaaaagaaaugaugcaa

SEQ ID NO: 13129 - RNA, 27 nt, Artificial Sequence
  Synthetic oligonucleotide
aagaugaucaaaaagaaaugaugcaaa

SEQ ID NO: 13130 - RNA, 27 nt, Artificial Sequence
  Synthetic oligonucleotide
agaugaucaaaaagaaaugaugcaaac

SEQ ID NO: 13131 - RNA, 27 nt, Artificial Sequence
  Synthetic oligonucleotide
gaugaucaaaaagaaaugaugcaaaca

SEQ ID NO: 13132 - RNA, 27 nt, Artificial Sequence
  Synthetic oligonucleotide
augaucaaaaagaaaugaugcaaacag

SEQ ID NO: 13133 - RNA, 27 nt, Artificial Sequence
  Synthetic oligonucleotide
ugaucaaaaagaaaugaugcaaacagc

SEQ ID NO: 13134 - RNA, 27 nt, Artificial Sequence
  Synthetic oligonucleotide
gaucaaaaagaaaugaugcaaacagca

SEQ ID NO: 13135 - RNA, 27 nt, Artificial Sequence
  Synthetic oligonucleotide
aucaaaaagaaaugaugcaaacagcaa

SEQ ID NO: 13136 - RNA, 27 nt, Artificial Sequence
  Synthetic oligonucleotide
ucaaaaagaaaugaugcaaacagcaau

SEQ ID NO: 13137 - RNA, 27 nt, Artificial Sequence
  Synthetic oligonucleotide
caaaaagaaaugaugcaaacagcaaug

SEQ ID NO: 13138 - RNA, 27 nt, Artificial Sequence
  Synthetic oligonucleotide
aaaaagaaaugaugcaaacagcaaugc

SEQ ID NO: 13139 - RNA, 27 nt, Artificial Sequence
  Synthetic oligonucleotide
aaaagaaaugaugcaaacagcaaugca

SEQ ID NO: 13140 - RNA, 27 nt, Artificial Sequence
  Synthetic oligonucleotide
aaagaaaugaugcaaacagcaaugcaa

SEQ ID NO: 13141 - RNA, 27 nt, Artificial Sequence
  Synthetic oligonucleotide
aagaaaugaugcaaacagcaaugcaaa

SEQ ID NO: 13142 - RNA, 27 nt, Artificial Sequence
  Synthetic oligonucleotide
agaaaugaugcaaacagcaaugcaaaa

SEQ ID NO: 13143 - RNA, 27 nt, Artificial Sequence
  Synthetic oligonucleotide
gaaaugaugcaaacagcaaugcaaaac

SEQ ID NO: 13144 - RNA, 27 nt, Artificial Sequence
  Synthetic oligonucleotide
aaaugaugcaaacagcaaugcaaaaca

SEQ ID NO: 13145 - RNA, 27 nt, Artificial Sequence
  Synthetic oligonucleotide
aaugaugcaaacagcaaugcaaaacac

SEQ ID NO: 13146 - RNA, 27 nt, Artificial Sequence
  Synthetic oligonucleotide
caauguugauaaauggaauugcucaag

SEQ ID NO: 13147 - RNA, 27 nt, Artificial Sequence
  Synthetic oligonucleotide
guugauaaauggaauugcucaagucac

SEQ ID NO: 13148 - RNA, 27 nt, Artificial Sequence
  Synthetic oligonucleotide
uugauaaauggaauugcucaagucaca

SEQ ID NO: 13149 - RNA, 27 nt, Artificial Sequence
  Synthetic oligonucleotide
gauaaauggaauugcucaagucacauu

SEQ ID NO: 13150 - RNA, 27 nt, Artificial Sequence
  Synthetic oligonucleotide
auaaauggaauugcucaagucacauuu

SEQ ID NO: 13151 - RNA, 27 nt, Artificial Sequence
  Synthetic oligonucleotide
uaaauggaauugcucaagucacauuug

SEQ ID NO: 13152 - RNA, 27 nt, Artificial Sequence
  Synthetic oligonucleotide
aauggaauugcucaagucacauuugau

SEQ ID NO: 13153 - RNA, 27 nt, Artificial Sequence
  Synthetic oligonucleotide
auggaauugcucaagucacauuugauu

SEQ ID NO: 13154 - RNA, 27 nt, Artificial Sequence
  Synthetic oligonucleotide
uggaauugcucaagucacauuugauuc

SEQ ID NO: 13155 - RNA, 27 nt, Artificial Sequence
  Synthetic oligonucleotide
ggaauugcucaagucacauuugauucu

SEQ ID NO: 13156 - RNA, 27 nt, Artificial Sequence
  Synthetic oligonucleotide
gaauugcucaagucacauuugauucug

SEQ ID NO: 13157 - RNA, 27 nt, Artificial Sequence
  Synthetic oligonucleotide
aauugcucaagucacauuugauucuga

SEQ ID NO: 13158 - RNA, 27 nt, Artificial Sequence
  Synthetic oligonucleotide
auugcucaagucacauuugauucugaa

SEQ ID NO: 13159 - RNA, 27 nt, Artificial Sequence
  Synthetic oligonucleotide
uugcucaagucacauuugauucugaaa

SEQ ID NO: 13160 - RNA, 27 nt, Artificial Sequence
  Synthetic oligonucleotide
gcucaagucacauuugauucugaaaca

SEQ ID NO: 13161 - RNA, 27 nt, Artificial Sequence
  Synthetic oligonucleotide
aagucacauuugauucugaaacagcag

SEQ ID NO: 13162 - RNA, 27 nt, Artificial Sequence
  Synthetic oligonucleotide
agucacauuugauucugaaacagcagu

SEQ ID NO: 13163 - RNA, 27 nt, Artificial Sequence
  Synthetic oligonucleotide
gucacauuugauucugaaacagcaguc

SEQ ID NO: 13164 - RNA, 27 nt, Artificial Sequence
  Synthetic oligonucleotide
ucacauuugauucugaaacagcaguca

SEQ ID NO: 13165 - RNA, 27 nt, Artificial Sequence
  Synthetic oligonucleotide
acauuugauucugaaacagcagucaaa

SEQ ID NO: 13166 - RNA, 27 nt, Artificial Sequence
  Synthetic oligonucleotide
uuugauucugaaacagcagucaaagaa

SEQ ID NO: 13167 - RNA, 27 nt, Artificial Sequence
  Synthetic oligonucleotide
uugauucugaaacagcagucaaagaac

SEQ ID NO: 13168 - RNA, 27 nt, Artificial Sequence
  Synthetic oligonucleotide
ugauucugaaacagcagucaaagaacu

SEQ ID NO: 13169 - RNA, 27 nt, Artificial Sequence
  Synthetic oligonucleotide
gauucugaaacagcagucaaagaacug

SEQ ID NO: 13170 - RNA, 27 nt, Artificial Sequence
  Synthetic oligonucleotide
auucugaaacagcagucaaagaacugu

SEQ ID NO: 13171 - RNA, 27 nt, Artificial Sequence
  Synthetic oligonucleotide
uucugaaacagcagucaaagaacuguc

SEQ ID NO: 13172 - RNA, 27 nt, Artificial Sequence
  Synthetic oligonucleotide
ucugaaacagcagucaaagaacuguca

SEQ ID NO: 13173 - RNA, 27 nt, Artificial Sequence
  Synthetic oligonucleotide
cugaaacagcagucaaagaacugucau

SEQ ID NO: 13174 - RNA, 27 nt, Artificial Sequence
  Synthetic oligonucleotide
ugaaacagcagucaaagaacugucaua

SEQ ID NO: 13175 - RNA, 27 nt, Artificial Sequence
  Synthetic oligonucleotide
gaaacagcagucaaagaacugucauac

SEQ ID NO: 13176 - RNA, 27 nt, Artificial Sequence
  Synthetic oligonucleotide
aaacagcagucaaagaacugucauacu

SEQ ID NO: 13177 - RNA, 27 nt, Artificial Sequence
  Synthetic oligonucleotide
acagcagucaaagaacugucauacuac

SEQ ID NO: 13178 - RNA, 27 nt, Artificial Sequence
  Synthetic oligonucleotide
agcagucaaagaacugucauacuacag

SEQ ID NO: 13179 - RNA, 27 nt, Artificial Sequence
  Synthetic oligonucleotide
gcagucaaagaacugucauacuacagu

SEQ ID NO: 13180 - RNA, 27 nt, Artificial Sequence
  Synthetic oligonucleotide
agucaaagaacugucauacuacaguuu

SEQ ID NO: 13181 - RNA, 27 nt, Artificial Sequence
  Synthetic oligonucleotide
gucaaagaacugucauacuacaguuua

SEQ ID NO: 13182 - RNA, 27 nt, Artificial Sequence
  Synthetic oligonucleotide
ucaaagaacugucauacuacaguuuag

SEQ ID NO: 13183 - RNA, 27 nt, Artificial Sequence
  Synthetic oligonucleotide
aagaacugucauacuacaguuuagaag

SEQ ID NO: 13184 - RNA, 27 nt, Artificial Sequence
  Synthetic oligonucleotide
gaacugucauacuacaguuuagaagau

SEQ ID NO: 13185 - RNA, 27 nt, Artificial Sequence
  Synthetic oligonucleotide
aacugucauacuacaguuuagaagauu

SEQ ID NO: 13186 - RNA, 27 nt, Artificial Sequence
  Synthetic oligonucleotide
acugucauacuacaguuuagaagauuu

SEQ ID NO: 13187 - RNA, 27 nt, Artificial Sequence
  Synthetic oligonucleotide
cugucauacuacaguuuagaagauuua

SEQ ID NO: 13188 - RNA, 27 nt, Artificial Sequence
  Synthetic oligonucleotide
ugucauacuacaguuuagaagauuuaa

SEQ ID NO: 13189 - RNA, 27 nt, Artificial Sequence
  Synthetic oligonucleotide
gucauacuacaguuuagaagauuuaaa

SEQ ID NO: 13190 - RNA, 27 nt, Artificial Sequence
  Synthetic oligonucleotide
ucauacuacaguuuagaagauuuaaac

SEQ ID NO: 13191 - RNA, 27 nt, Artificial Sequence
  Synthetic oligonucleotide
cauacuacaguuuagaagauuuaaaca

SEQ ID NO: 13192 - RNA, 27 nt, Artificial Sequence
  Synthetic oligonucleotide
auacuacaguuuagaagauuuaaacaa

SEQ ID NO: 13193 - RNA, 27 nt, Artificial Sequence
  Synthetic oligonucleotide
uacuacaguuuagaagauuuaaacaac

SEQ ID NO: 13194 - RNA, 27 nt, Artificial Sequence
  Synthetic oligonucleotide
acuacaguuuagaagauuuaaacaaca

SEQ ID NO: 13195 - RNA, 27 nt, Artificial Sequence
  Synthetic oligonucleotide
cuacaguuuagaagauuuaaacaacaa

SEQ ID NO: 13196 - RNA, 27 nt, Artificial Sequence
  Synthetic oligonucleotide
uacaguuuagaagauuuaaacaacaag

SEQ ID NO: 13197 - RNA, 27 nt, Artificial Sequence
  Synthetic oligonucleotide
acaguuuagaagauuuaaacaacaagu

SEQ ID NO: 13198 - RNA, 27 nt, Artificial Sequence
  Synthetic oligonucleotide
caguuuagaagauuuaaacaacaagua

SEQ ID NO: 13199 - RNA, 27 nt, Artificial Sequence
  Synthetic oligonucleotide
aguuuagaagauuuaaacaacaaguac

SEQ ID NO: 13200 - RNA, 27 nt, Artificial Sequence
  Synthetic oligonucleotide
guuuagaagauuuaaacaacaaguacc

SEQ ID NO: 13201 - RNA, 27 nt, Artificial Sequence
  Synthetic oligonucleotide
uuuagaagauuuaaacaacaaguaccu

SEQ ID NO: 13202 - RNA, 27 nt, Artificial Sequence
  Synthetic oligonucleotide
uuagaagauuuaaacaacaaguaccuu

SEQ ID NO: 13203 - RNA, 27 nt, Artificial Sequence
  Synthetic oligonucleotide
uagaagauuuaaacaacaaguaccuuu

SEQ ID NO: 13204 - RNA, 27 nt, Artificial Sequence
  Synthetic oligonucleotide
agaagauuuaaacaacaaguaccuuua

SEQ ID NO: 13205 - RNA, 27 nt, Artificial Sequence
  Synthetic oligonucleotide
gaagauuuaaacaacaaguaccuuuau

SEQ ID NO: 13206 - RNA, 27 nt, Artificial Sequence
  Synthetic oligonucleotide
aagauuuaaacaacaaguaccuuuaua

SEQ ID NO: 13207 - RNA, 27 nt, Artificial Sequence
  Synthetic oligonucleotide
agauuuaaacaacaaguaccuuuauau

SEQ ID NO: 13208 - RNA, 27 nt, Artificial Sequence
  Synthetic oligonucleotide
gauuuaaacaacaaguaccuuuauauu

SEQ ID NO: 13209 - RNA, 27 nt, Artificial Sequence
  Synthetic oligonucleotide
aguaccuuuauauugcuguaacaguca

SEQ ID NO: 13210 - RNA, 27 nt, Artificial Sequence
  Synthetic oligonucleotide
uaccuuuauauugcuguaacagucaua

SEQ ID NO: 13211 - RNA, 27 nt, Artificial Sequence
  Synthetic oligonucleotide
accuuuauauugcuguaacagucauag

SEQ ID NO: 13212 - RNA, 27 nt, Artificial Sequence
  Synthetic oligonucleotide
ccuuuauauugcuguaacagucauaga

SEQ ID NO: 13213 - RNA, 27 nt, Artificial Sequence
  Synthetic oligonucleotide
cuuuauauugcuguaacagucauagag

SEQ ID NO: 13214 - RNA, 27 nt, Artificial Sequence
  Synthetic oligonucleotide
uuuauauugcuguaacagucauagagu

SEQ ID NO: 13215 - RNA, 27 nt, Artificial Sequence
  Synthetic oligonucleotide
uuauauugcuguaacagucauagaguc

SEQ ID NO: 13216 - RNA, 27 nt, Artificial Sequence
  Synthetic oligonucleotide
uauauugcuguaacagucauagagucu

SEQ ID NO: 13217 - RNA, 27 nt, Artificial Sequence
  Synthetic oligonucleotide
auauugcuguaacagucauagagucua

SEQ ID NO: 13218 - RNA, 27 nt, Artificial Sequence
  Synthetic oligonucleotide
uauugcuguaacagucauagagucuac

SEQ ID NO: 13219 - RNA, 27 nt, Artificial Sequence
  Synthetic oligonucleotide
auugcuguaacagucauagagucuaca

SEQ ID NO: 13220 - RNA, 27 nt, Artificial Sequence
  Synthetic oligonucleotide
uugcuguaacagucauagagucuacag

SEQ ID NO: 13221 - RNA, 27 nt, Artificial Sequence
  Synthetic oligonucleotide
ugcuguaacagucauagagucuacagg

SEQ ID NO: 13222 - RNA, 27 nt, Artificial Sequence
  Synthetic oligonucleotide
gcuguaacagucauagagucuacaggu

SEQ ID NO: 13223 - RNA, 27 nt, Artificial Sequence
  Synthetic oligonucleotide
cuguaacagucauagagucuacaggug

SEQ ID NO: 13224 - RNA, 27 nt, Artificial Sequence
  Synthetic oligonucleotide
uguaacagucauagagucuacaggugg

SEQ ID NO: 13225 - RNA, 27 nt, Artificial Sequence
  Synthetic oligonucleotide
guaacagucauagagucuacaggugga

SEQ ID NO: 13226 - RNA, 27 nt, Artificial Sequence
  Synthetic oligonucleotide
uaacagucauagagucuacagguggau

SEQ ID NO: 13227 - RNA, 27 nt, Artificial Sequence
  Synthetic oligonucleotide
aacagucauagagucuacagguggauu

SEQ ID NO: 13228 - RNA, 27 nt, Artificial Sequence
  Synthetic oligonucleotide
acagucauagagucuacagguggauuu

SEQ ID NO: 13229 - RNA, 27 nt, Artificial Sequence
  Synthetic oligonucleotide
cagucauagagucuacagguggauuuu

SEQ ID NO: 13230 - RNA, 27 nt, Artificial Sequence
  Synthetic oligonucleotide
agucauagagucuacagguggauuuuc

SEQ ID NO: 13231 - RNA, 27 nt, Artificial Sequence
  Synthetic oligonucleotide
gucauagagucuacagguggauuuucu

SEQ ID NO: 13232 - RNA, 27 nt, Artificial Sequence
  Synthetic oligonucleotide
ucauagagucuacagguggauuuucug

SEQ ID NO: 13233 - RNA, 27 nt, Artificial Sequence
  Synthetic oligonucleotide
cauagagucuacagguggauuuucuga

SEQ ID NO: 13234 - RNA, 27 nt, Artificial Sequence
  Synthetic oligonucleotide
auagagucuacagguggauuuucugaa

SEQ ID NO: 13235 - RNA, 27 nt, Artificial Sequence
  Synthetic oligonucleotide
uagagucuacagguggauuuucugaag

SEQ ID NO: 13236 - RNA, 27 nt, Artificial Sequence
  Synthetic oligonucleotide
agagucuacagguggauuuucugaaga

SEQ ID NO: 13237 - RNA, 27 nt, Artificial Sequence
  Synthetic oligonucleotide
gagucuacagguggauuuucugaagag

SEQ ID NO: 13238 - RNA, 27 nt, Artificial Sequence
  Synthetic oligonucleotide
agucuacagguggauuuucugaagagg

SEQ ID NO: 13239 - RNA, 27 nt, Artificial Sequence
  Synthetic oligonucleotide
gucuacagguggauuuucugaagaggc

SEQ ID NO: 13240 - RNA, 27 nt, Artificial Sequence
  Synthetic oligonucleotide
ucuacagguggauuuucugaagaggca

SEQ ID NO: 13241 - RNA, 27 nt, Artificial Sequence
  Synthetic oligonucleotide
cuacagguggauuuucugaagaggcag

SEQ ID NO: 13242 - RNA, 27 nt, Artificial Sequence
  Synthetic oligonucleotide
uacagguggauuuucugaagaggcaga

SEQ ID NO: 13243 - RNA, 27 nt, Artificial Sequence
  Synthetic oligonucleotide
acagguggauuuucugaagaggcagaa

SEQ ID NO: 13244 - RNA, 27 nt, Artificial Sequence
  Synthetic oligonucleotide
cagguggauuuucugaagaggcagaaa

SEQ ID NO: 13245 - RNA, 27 nt, Artificial Sequence
  Synthetic oligonucleotide
agguggauuuucugaagaggcagaaau

SEQ ID NO: 13246 - RNA, 27 nt, Artificial Sequence
  Synthetic oligonucleotide
gguggauuuucugaagaggcagaaaua

SEQ ID NO: 13247 - RNA, 27 nt, Artificial Sequence
  Synthetic oligonucleotide
guggauuuucugaagaggcagaaauac

SEQ ID NO: 13248 - RNA, 27 nt, Artificial Sequence
  Synthetic oligonucleotide
uggauuuucugaagaggcagaaauacc

SEQ ID NO: 13249 - RNA, 27 nt, Artificial Sequence
  Synthetic oligonucleotide
ggauuuucugaagaggcagaaauaccu

SEQ ID NO: 13250 - RNA, 27 nt, Artificial Sequence
  Synthetic oligonucleotide
gauuuucugaagaggcagaaauaccug

SEQ ID NO: 13251 - RNA, 27 nt, Artificial Sequence
  Synthetic oligonucleotide
auuuucugaagaggcagaaauaccugg

SEQ ID NO: 13252 - RNA, 27 nt, Artificial Sequence
  Synthetic oligonucleotide
uuuucugaagaggcagaaauaccuggc

SEQ ID NO: 13253 - RNA, 27 nt, Artificial Sequence
  Synthetic oligonucleotide
uuucugaagaggcagaaauaccuggca

SEQ ID NO: 13254 - RNA, 27 nt, Artificial Sequence
  Synthetic oligonucleotide
uucugaagaggcagaaauaccuggcau

SEQ ID NO: 13255 - RNA, 27 nt, Artificial Sequence
  Synthetic oligonucleotide
ucugaagaggcagaaauaccuggcauc

SEQ ID NO: 13256 - RNA, 27 nt, Artificial Sequence
  Synthetic oligonucleotide
cugaagaggcagaaauaccuggcauca

SEQ ID NO: 13257 - RNA, 27 nt, Artificial Sequence
  Synthetic oligonucleotide
ugaagaggcagaaauaccuggcaucaa

SEQ ID NO: 13258 - RNA, 27 nt, Artificial Sequence
  Synthetic oligonucleotide
gaagaggcagaaauaccuggcaucaaa

SEQ ID NO: 13259 - RNA, 27 nt, Artificial Sequence
  Synthetic oligonucleotide
aagaggcagaaauaccuggcaucaaau

SEQ ID NO: 13260 - RNA, 27 nt, Artificial Sequence
  Synthetic oligonucleotide
agaggcagaaauaccuggcaucaaaua

SEQ ID NO: 13261 - RNA, 27 nt, Artificial Sequence
  Synthetic oligonucleotide
gaggcagaaauaccuggcaucaaauau

SEQ ID NO: 13262 - RNA, 27 nt, Artificial Sequence
  Synthetic oligonucleotide
aggcagaaauaccuggcaucaaauaug

SEQ ID NO: 13263 - RNA, 27 nt, Artificial Sequence
  Synthetic oligonucleotide
ggcagaaauaccuggcaucaaauaugu

SEQ ID NO: 13264 - RNA, 27 nt, Artificial Sequence
  Synthetic oligonucleotide
gcagaaauaccuggcaucaaauauguc

SEQ ID NO: 13265 - RNA, 27 nt, Artificial Sequence
  Synthetic oligonucleotide
cagaaauaccuggcaucaaauaugucc

SEQ ID NO: 13266 - RNA, 27 nt, Artificial Sequence
  Synthetic oligonucleotide
agaaauaccuggcaucaaauauguccu

SEQ ID NO: 13267 - RNA, 27 nt, Artificial Sequence
  Synthetic oligonucleotide
gaaauaccuggcaucaaauauguccuc

SEQ ID NO: 13268 - RNA, 27 nt, Artificial Sequence
  Synthetic oligonucleotide
aaauaccuggcaucaaauauguccucu

SEQ ID NO: 13269 - RNA, 27 nt, Artificial Sequence
  Synthetic oligonucleotide
aauaccuggcaucaaauauguccucuc

SEQ ID NO: 13270 - RNA, 27 nt, Artificial Sequence
  Synthetic oligonucleotide
auaccuggcaucaaauauguccucucu

SEQ ID NO: 13271 - RNA, 27 nt, Artificial Sequence
  Synthetic oligonucleotide
uaccuggcaucaaauauguccucucuc

SEQ ID NO: 13272 - RNA, 27 nt, Artificial Sequence
  Synthetic oligonucleotide
accuggcaucaaauauguccucucucc

SEQ ID NO: 13273 - RNA, 27 nt, Artificial Sequence
  Synthetic oligonucleotide
ccuggcaucaaauauguccucucuccc

SEQ ID NO: 13274 - RNA, 27 nt, Artificial Sequence
  Synthetic oligonucleotide
cuggcaucaaauauguccucucucccu

SEQ ID NO: 13275 - RNA, 27 nt, Artificial Sequence
  Synthetic oligonucleotide
uggcaucaaauauguccucucucccua

SEQ ID NO: 13276 - RNA, 27 nt, Artificial Sequence
  Synthetic oligonucleotide
ggcaucaaauauguccucucucccuac

SEQ ID NO: 13277 - RNA, 27 nt, Artificial Sequence
  Synthetic oligonucleotide
gcaucaaauauguccucucucccuaca

SEQ ID NO: 13278 - RNA, 27 nt, Artificial Sequence
  Synthetic oligonucleotide
aucaaauauguccucucucccuacaaa

SEQ ID NO: 13279 - RNA, 27 nt, Artificial Sequence
  Synthetic oligonucleotide
ucaaauauguccucucucccuacaaac

SEQ ID NO: 13280 - RNA, 27 nt, Artificial Sequence
  Synthetic oligonucleotide
caaauauguccucucucccuacaaacu

SEQ ID NO: 13281 - RNA, 27 nt, Artificial Sequence
  Synthetic oligonucleotide
aaauauguccucucucccuacaaacug

SEQ ID NO: 13282 - RNA, 27 nt, Artificial Sequence
  Synthetic oligonucleotide
aauauguccucucucccuacaaacuga

SEQ ID NO: 13283 - RNA, 27 nt, Artificial Sequence
  Synthetic oligonucleotide
auauguccucucucccuacaaacugaa

SEQ ID NO: 13284 - RNA, 27 nt, Artificial Sequence
  Synthetic oligonucleotide
uauguccucucucccuacaaacugaau

SEQ ID NO: 13285 - RNA, 27 nt, Artificial Sequence
  Synthetic oligonucleotide
auguccucucucccuacaaacugaauu

SEQ ID NO: 13286 - RNA, 27 nt, Artificial Sequence
  Synthetic oligonucleotide
uguccucucucccuacaaacugaauuu

SEQ ID NO: 13287 - RNA, 27 nt, Artificial Sequence
  Synthetic oligonucleotide
guccucucucccuacaaacugaauuug

SEQ ID NO: 13288 - RNA, 27 nt, Artificial Sequence
  Synthetic oligonucleotide
uccucucucccuacaaacugaauuugg

SEQ ID NO: 13289 - RNA, 27 nt, Artificial Sequence
  Synthetic oligonucleotide
ccucucucccuacaaacugaauuuggu

SEQ ID NO: 13290 - RNA, 27 nt, Artificial Sequence
  Synthetic oligonucleotide
cucucucccuacaaacugaauuugguu

SEQ ID NO: 13291 - RNA, 27 nt, Artificial Sequence
  Synthetic oligonucleotide
ucucucccuacaaacugaauuugguug

SEQ ID NO: 13292 - RNA, 27 nt, Artificial Sequence
  Synthetic oligonucleotide
cucucccuacaaacugaauuugguugc

SEQ ID NO: 13293 - RNA, 27 nt, Artificial Sequence
  Synthetic oligonucleotide
ucucccuacaaacugaauuugguugcu

SEQ ID NO: 13294 - RNA, 27 nt, Artificial Sequence
  Synthetic oligonucleotide
ucccuacaaacugaauuugguugcuac

SEQ ID NO: 13295 - RNA, 27 nt, Artificial Sequence
  Synthetic oligonucleotide
cccuacaaacugaauuugguugcuacu

SEQ ID NO: 13296 - RNA, 27 nt, Artificial Sequence
  Synthetic oligonucleotide
ccuacaaacugaauuugguugcuacuc

SEQ ID NO: 13297 - RNA, 27 nt, Artificial Sequence
  Synthetic oligonucleotide
acaaacugaauuugguugcuacuccuc

SEQ ID NO: 13298 - RNA, 27 nt, Artificial Sequence
  Synthetic oligonucleotide
caaacugaauuugguugcuacuccucu

SEQ ID NO: 13299 - RNA, 27 nt, Artificial Sequence
  Synthetic oligonucleotide
aaacugaauuugguugcuacuccucuu

SEQ ID NO: 13300 - RNA, 27 nt, Artificial Sequence
  Synthetic oligonucleotide
aacugaauuugguugcuacuccucuuu

SEQ ID NO: 13301 - RNA, 27 nt, Artificial Sequence
  Synthetic oligonucleotide
acugaauuugguugcuacuccucuuuu

SEQ ID NO: 13302 - RNA, 27 nt, Artificial Sequence
  Synthetic oligonucleotide
cugaauuugguugcuacuccucuuuuc

SEQ ID NO: 13303 - RNA, 27 nt, Artificial Sequence
  Synthetic oligonucleotide
ugaauuugguugcuacuccucuuuucc

SEQ ID NO: 13304 - RNA, 27 nt, Artificial Sequence
  Synthetic oligonucleotide
gaauuugguugcuacuccucuuuuccu

SEQ ID NO: 13305 - RNA, 27 nt, Artificial Sequence
  Synthetic oligonucleotide
aauuugguugcuacuccucuuuuccug

SEQ ID NO: 13306 - RNA, 27 nt, Artificial Sequence
  Synthetic oligonucleotide
auuugguugcuacuccucuuuuccuga

SEQ ID NO: 13307 - RNA, 27 nt, Artificial Sequence
  Synthetic oligonucleotide
uuugguugcuacuccucuuuuccugaa

SEQ ID NO: 13308 - RNA, 27 nt, Artificial Sequence
  Synthetic oligonucleotide
uugguugcuacuccucuuuuccugaag

SEQ ID NO: 13309 - RNA, 27 nt, Artificial Sequence
  Synthetic oligonucleotide
ugguugcuacuccucuuuuccugaagc

SEQ ID NO: 13310 - RNA, 27 nt, Artificial Sequence
  Synthetic oligonucleotide
gguugcuacuccucuuuuccugaagcc

SEQ ID NO: 13311 - RNA, 27 nt, Artificial Sequence
  Synthetic oligonucleotide
guugcuacuccucuuuuccugaagccu

SEQ ID NO: 13312 - RNA, 27 nt, Artificial Sequence
  Synthetic oligonucleotide
uugcuacuccucuuuuccugaagccug

SEQ ID NO: 13313 - RNA, 27 nt, Artificial Sequence
  Synthetic oligonucleotide
ugcuacuccucuuuuccugaagccugg

SEQ ID NO: 13314 - RNA, 27 nt, Artificial Sequence
  Synthetic oligonucleotide
gcuacuccucuuuuccugaagccuggg

SEQ ID NO: 13315 - RNA, 27 nt, Artificial Sequence
  Synthetic oligonucleotide
cuacuccucuuuuccugaagccuggga

SEQ ID NO: 13316 - RNA, 27 nt, Artificial Sequence
  Synthetic oligonucleotide
uacuccucuuuuccugaagccugggau

SEQ ID NO: 13317 - RNA, 27 nt, Artificial Sequence
  Synthetic oligonucleotide
acuccucuuuuccugaagccugggauu

SEQ ID NO: 13318 - RNA, 27 nt, Artificial Sequence
  Synthetic oligonucleotide
cuccucuuuuccugaagccugggauuc

SEQ ID NO: 13319 - RNA, 27 nt, Artificial Sequence
  Synthetic oligonucleotide
uccucuuuuccugaagccugggauucc

SEQ ID NO: 13320 - RNA, 27 nt, Artificial Sequence
  Synthetic oligonucleotide
ccucuuuuccugaagccugggauucca

SEQ ID NO: 13321 - RNA, 27 nt, Artificial Sequence
  Synthetic oligonucleotide
cucuuuuccugaagccugggauuccau

SEQ ID NO: 13322 - RNA, 27 nt, Artificial Sequence
  Synthetic oligonucleotide
ucuuuuccugaagccugggauuccaua

SEQ ID NO: 13323 - RNA, 27 nt, Artificial Sequence
  Synthetic oligonucleotide
cuuuuccugaagccugggauuccauau

SEQ ID NO: 13324 - RNA, 27 nt, Artificial Sequence
  Synthetic oligonucleotide
uuuuccugaagccugggauuccauauc

SEQ ID NO: 13325 - RNA, 27 nt, Artificial Sequence
  Synthetic oligonucleotide
uuuccugaagccugggauuccauaucc

SEQ ID NO: 13326 - RNA, 27 nt, Artificial Sequence
  Synthetic oligonucleotide
uuccugaagccugggauuccauauccc

SEQ ID NO: 13327 - RNA, 27 nt, Artificial Sequence
  Synthetic oligonucleotide
uccugaagccugggauuccauauccca

SEQ ID NO: 13328 - RNA, 27 nt, Artificial Sequence
  Synthetic oligonucleotide
ccugaagccugggauuccauaucccau

SEQ ID NO: 13329 - RNA, 27 nt, Artificial Sequence
  Synthetic oligonucleotide
cugaagccugggauuccauaucccauc

SEQ ID NO: 13330 - RNA, 27 nt, Artificial Sequence
  Synthetic oligonucleotide
ucccaucaaggugcagguuaaagauuc

SEQ ID NO: 13331 - RNA, 27 nt, Artificial Sequence
  Synthetic oligonucleotide
cccaucaaggugcagguuaaagauucg

SEQ ID NO: 13332 - RNA, 27 nt, Artificial Sequence
  Synthetic oligonucleotide
ccaucaaggugcagguuaaagauucgc

SEQ ID NO: 13333 - RNA, 27 nt, Artificial Sequence
  Synthetic oligonucleotide
caucaaggugcagguuaaagauucgcu

SEQ ID NO: 13334 - RNA, 27 nt, Artificial Sequence
  Synthetic oligonucleotide
aucaaggugcagguuaaagauucgcuu

SEQ ID NO: 13335 - RNA, 27 nt, Artificial Sequence
  Synthetic oligonucleotide
uucgcuugaccaguugguaggaggagu

SEQ ID NO: 13336 - RNA, 27 nt, Artificial Sequence
  Synthetic oligonucleotide
ucgcuugaccaguugguaggaggaguc

SEQ ID NO: 13337 - RNA, 27 nt, Artificial Sequence
  Synthetic oligonucleotide
cgcuugaccaguugguaggaggagucc

SEQ ID NO: 13338 - RNA, 27 nt, Artificial Sequence
  Synthetic oligonucleotide
gcuugaccaguugguaggaggaguccc

SEQ ID NO: 13339 - RNA, 27 nt, Artificial Sequence
  Synthetic oligonucleotide
gagucccaguaacacugaaugcacaaa

SEQ ID NO: 13340 - RNA, 27 nt, Artificial Sequence
  Synthetic oligonucleotide
agucccaguaacacugaaugcacaaac

SEQ ID NO: 13341 - RNA, 27 nt, Artificial Sequence
  Synthetic oligonucleotide
gucccaguaacacugaaugcacaaaca

SEQ ID NO: 13342 - RNA, 27 nt, Artificial Sequence
  Synthetic oligonucleotide
ucccaguaacacugaaugcacaaacaa

SEQ ID NO: 13343 - RNA, 27 nt, Artificial Sequence
  Synthetic oligonucleotide
cccaguaacacugaaugcacaaacaau

SEQ ID NO: 13344 - RNA, 27 nt, Artificial Sequence
  Synthetic oligonucleotide
ccaguaacacugaaugcacaaacaauu

SEQ ID NO: 13345 - RNA, 27 nt, Artificial Sequence
  Synthetic oligonucleotide
caguaacacugaaugcacaaacaauug

SEQ ID NO: 13346 - RNA, 27 nt, Artificial Sequence
  Synthetic oligonucleotide
aguaacacugaaugcacaaacaauuga

SEQ ID NO: 13347 - RNA, 27 nt, Artificial Sequence
  Synthetic oligonucleotide
guaacacugaaugcacaaacaauugau

SEQ ID NO: 13348 - RNA, 27 nt, Artificial Sequence
  Synthetic oligonucleotide
uaacacugaaugcacaaacaauugaug

SEQ ID NO: 13349 - RNA, 27 nt, Artificial Sequence
  Synthetic oligonucleotide
aacacugaaugcacaaacaauugaugu

SEQ ID NO: 13350 - RNA, 27 nt, Artificial Sequence
  Synthetic oligonucleotide
acacugaaugcacaaacaauugaugua

SEQ ID NO: 13351 - RNA, 27 nt, Artificial Sequence
  Synthetic oligonucleotide
cugaaugcacaaacaauugauguaaac

SEQ ID NO: 13352 - RNA, 27 nt, Artificial Sequence
  Synthetic oligonucleotide
ugaaugcacaaacaauugauguaaacc

SEQ ID NO: 13353 - RNA, 27 nt, Artificial Sequence
  Synthetic oligonucleotide
gaaugcacaaacaauugauguaaacca

SEQ ID NO: 13354 - RNA, 27 nt, Artificial Sequence
  Synthetic oligonucleotide
uaaaccaagagacaucugacuuggauc

SEQ ID NO: 13355 - RNA, 27 nt, Artificial Sequence
  Synthetic oligonucleotide
aaaccaagagacaucugacuuggaucc

SEQ ID NO: 13356 - RNA, 27 nt, Artificial Sequence
  Synthetic oligonucleotide
aaccaagagacaucugacuuggaucca

SEQ ID NO: 13357 - RNA, 27 nt, Artificial Sequence
  Synthetic oligonucleotide
gcaaaaguguaacacguguugaugaug

SEQ ID NO: 13358 - RNA, 27 nt, Artificial Sequence
  Synthetic oligonucleotide
caaaaguguaacacguguugaugaugg

SEQ ID NO: 13359 - RNA, 27 nt, Artificial Sequence
  Synthetic oligonucleotide
aaaaguguaacacguguugaugaugga

SEQ ID NO: 13360 - RNA, 27 nt, Artificial Sequence
  Synthetic oligonucleotide
aaaguguaacacguguugaugauggag

SEQ ID NO: 13361 - RNA, 27 nt, Artificial Sequence
  Synthetic oligonucleotide
aaguguaacacguguugaugauggagu

SEQ ID NO: 13362 - RNA, 27 nt, Artificial Sequence
  Synthetic oligonucleotide
aguguaacacguguugaugauggagua

SEQ ID NO: 13363 - RNA, 27 nt, Artificial Sequence
  Synthetic oligonucleotide
guguaacacguguugaugauggaguag

SEQ ID NO: 13364 - RNA, 27 nt, Artificial Sequence
  Synthetic oligonucleotide
uguaacacguguugaugauggaguagc

SEQ ID NO: 13365 - RNA, 27 nt, Artificial Sequence
  Synthetic oligonucleotide
guaacacguguugaugauggaguagcu

SEQ ID NO: 13366 - RNA, 27 nt, Artificial Sequence
  Synthetic oligonucleotide
uaacacguguugaugauggaguagcuu

SEQ ID NO: 13367 - RNA, 27 nt, Artificial Sequence
  Synthetic oligonucleotide
aacacguguugaugauggaguagcuuc

SEQ ID NO: 13368 - RNA, 27 nt, Artificial Sequence
  Synthetic oligonucleotide
acacguguugaugauggaguagcuucc

SEQ ID NO: 13369 - RNA, 27 nt, Artificial Sequence
  Synthetic oligonucleotide
cacguguugaugauggaguagcuuccu

SEQ ID NO: 13370 - RNA, 27 nt, Artificial Sequence
  Synthetic oligonucleotide
acguguugaugauggaguagcuuccuu

SEQ ID NO: 13371 - RNA, 27 nt, Artificial Sequence
  Synthetic oligonucleotide
cguguugaugauggaguagcuuccuuu

SEQ ID NO: 13372 - RNA, 27 nt, Artificial Sequence
  Synthetic oligonucleotide
guguugaugauggaguagcuuccuuug

SEQ ID NO: 13373 - RNA, 27 nt, Artificial Sequence
  Synthetic oligonucleotide
uguugaugauggaguagcuuccuuugu

SEQ ID NO: 13374 - RNA, 27 nt, Artificial Sequence
  Synthetic oligonucleotide
gcuuaaucucccaucuggagugacggu

SEQ ID NO: 13375 - RNA, 27 nt, Artificial Sequence
  Synthetic oligonucleotide
cuuaaucucccaucuggagugacggug

SEQ ID NO: 13376 - RNA, 27 nt, Artificial Sequence
  Synthetic oligonucleotide
uuaaucucccaucuggagugacggugc

SEQ ID NO: 13377 - RNA, 27 nt, Artificial Sequence
  Synthetic oligonucleotide
uaaucucccaucuggagugacggugcu

SEQ ID NO: 13378 - RNA, 27 nt, Artificial Sequence
  Synthetic oligonucleotide
aaucucccaucuggagugacggugcug

SEQ ID NO: 13379 - RNA, 27 nt, Artificial Sequence
  Synthetic oligonucleotide
ucucccaucuggagugacggugcugga

SEQ ID NO: 13380 - RNA, 27 nt, Artificial Sequence
  Synthetic oligonucleotide
ucccaucuggagugacggugcuggagu

SEQ ID NO: 13381 - RNA, 27 nt, Artificial Sequence
  Synthetic oligonucleotide
cccaucuggagugacggugcuggaguu

SEQ ID NO: 13382 - RNA, 27 nt, Artificial Sequence
  Synthetic oligonucleotide
ccaucuggagugacggugcuggaguuu

SEQ ID NO: 13383 - RNA, 27 nt, Artificial Sequence
  Synthetic oligonucleotide
caucuggagugacggugcuggaguuua

SEQ ID NO: 13384 - RNA, 27 nt, Artificial Sequence
  Synthetic oligonucleotide
aucuggagugacggugcuggaguuuaa

SEQ ID NO: 13385 - RNA, 27 nt, Artificial Sequence
  Synthetic oligonucleotide
ucuggagugacggugcuggaguuuaau

SEQ ID NO: 13386 - RNA, 27 nt, Artificial Sequence
  Synthetic oligonucleotide
cuggagugacggugcuggaguuuaaug

SEQ ID NO: 13387 - RNA, 27 nt, Artificial Sequence
  Synthetic oligonucleotide
uggagugacggugcuggaguuuaaugu

SEQ ID NO: 13388 - RNA, 27 nt, Artificial Sequence
  Synthetic oligonucleotide
ggagugacggugcuggaguuuaauguc

SEQ ID NO: 13389 - RNA, 27 nt, Artificial Sequence
  Synthetic oligonucleotide
gagugacggugcuggaguuuaauguca

SEQ ID NO: 13390 - RNA, 27 nt, Artificial Sequence
  Synthetic oligonucleotide
agugacggugcuggaguuuaaugucaa

SEQ ID NO: 13391 - RNA, 27 nt, Artificial Sequence
  Synthetic oligonucleotide
gugacggugcuggaguuuaaugucaaa

SEQ ID NO: 13392 - RNA, 27 nt, Artificial Sequence
  Synthetic oligonucleotide
ugacggugcuggaguuuaaugucaaaa

SEQ ID NO: 13393 - RNA, 27 nt, Artificial Sequence
  Synthetic oligonucleotide
gacggugcuggaguuuaaugucaaaac

SEQ ID NO: 13394 - RNA, 27 nt, Artificial Sequence
  Synthetic oligonucleotide
acggugcuggaguuuaaugucaaaacu

SEQ ID NO: 13395 - RNA, 27 nt, Artificial Sequence
  Synthetic oligonucleotide
cggugcuggaguuuaaugucaaaacug

SEQ ID NO: 13396 - RNA, 27 nt, Artificial Sequence
  Synthetic oligonucleotide
ggugcuggaguuuaaugucaaaacuga

SEQ ID NO: 13397 - RNA, 27 nt, Artificial Sequence
  Synthetic oligonucleotide
gugcuggaguuuaaugucaaaacugau

SEQ ID NO: 13398 - RNA, 27 nt, Artificial Sequence
  Synthetic oligonucleotide
ugcuggaguuuaaugucaaaacugaug

SEQ ID NO: 13399 - RNA, 27 nt, Artificial Sequence
  Synthetic oligonucleotide
gcuggaguuuaaugucaaaacugaugc

SEQ ID NO: 13400 - RNA, 27 nt, Artificial Sequence
  Synthetic oligonucleotide
cuggaguuuaaugucaaaacugaugcu

SEQ ID NO: 13401 - RNA, 27 nt, Artificial Sequence
  Synthetic oligonucleotide
uggaguuuaaugucaaaacugaugcuc

SEQ ID NO: 13402 - RNA, 27 nt, Artificial Sequence
  Synthetic oligonucleotide
ggaguuuaaugucaaaacugaugcucc

SEQ ID NO: 13403 - RNA, 27 nt, Artificial Sequence
  Synthetic oligonucleotide
gaguuuaaugucaaaacugaugcucca

SEQ ID NO: 13404 - RNA, 27 nt, Artificial Sequence
  Synthetic oligonucleotide
aguuuaaugucaaaacugaugcuccag

SEQ ID NO: 13405 - RNA, 27 nt, Artificial Sequence
  Synthetic oligonucleotide
guuuaaugucaaaacugaugcuccaga

SEQ ID NO: 13406 - RNA, 27 nt, Artificial Sequence
  Synthetic oligonucleotide
uuuaaugucaaaacugaugcuccagau

SEQ ID NO: 13407 - RNA, 27 nt, Artificial Sequence
  Synthetic oligonucleotide
uuaaugucaaaacugaugcuccagauc

SEQ ID NO: 13408 - RNA, 27 nt, Artificial Sequence
  Synthetic oligonucleotide
uaaugucaaaacugaugcuccagaucu

SEQ ID NO: 13409 - RNA, 27 nt, Artificial Sequence
  Synthetic oligonucleotide
aaugucaaaacugaugcuccagaucuu

SEQ ID NO: 13410 - RNA, 27 nt, Artificial Sequence
  Synthetic oligonucleotide
augucaaaacugaugcuccagaucuuc

SEQ ID NO: 13411 - RNA, 27 nt, Artificial Sequence
  Synthetic oligonucleotide
ugucaaaacugaugcuccagaucuucc

SEQ ID NO: 13412 - RNA, 27 nt, Artificial Sequence
  Synthetic oligonucleotide
gucaaaacugaugcuccagaucuucca

SEQ ID NO: 13413 - RNA, 27 nt, Artificial Sequence
  Synthetic oligonucleotide
ucaaaacugaugcuccagaucuuccag

SEQ ID NO: 13414 - RNA, 27 nt, Artificial Sequence
  Synthetic oligonucleotide
caaaacugaugcuccagaucuuccaga

SEQ ID NO: 13415 - RNA, 27 nt, Artificial Sequence
  Synthetic oligonucleotide
aaaacugaugcuccagaucuuccagaa

SEQ ID NO: 13416 - RNA, 27 nt, Artificial Sequence
  Synthetic oligonucleotide
aaacugaugcuccagaucuuccagaag

SEQ ID NO: 13417 - RNA, 27 nt, Artificial Sequence
  Synthetic oligonucleotide
aacugaugcuccagaucuuccagaaga

SEQ ID NO: 13418 - RNA, 27 nt, Artificial Sequence
  Synthetic oligonucleotide
acugaugcuccagaucuuccagaagaa

SEQ ID NO: 13419 - RNA, 27 nt, Artificial Sequence
  Synthetic oligonucleotide
cugaugcuccagaucuuccagaagaaa

SEQ ID NO: 13420 - RNA, 27 nt, Artificial Sequence
  Synthetic oligonucleotide
ugaugcuccagaucuuccagaagaaaa

SEQ ID NO: 13421 - RNA, 27 nt, Artificial Sequence
  Synthetic oligonucleotide
aagaaaaucaggccagggaagguuacc

SEQ ID NO: 13422 - RNA, 27 nt, Artificial Sequence
  Synthetic oligonucleotide
agaaaaucaggccagggaagguuaccg

SEQ ID NO: 13423 - RNA, 27 nt, Artificial Sequence
  Synthetic oligonucleotide
gaaaaucaggccagggaagguuaccga

SEQ ID NO: 13424 - RNA, 27 nt, Artificial Sequence
  Synthetic oligonucleotide
aaaaucaggccagggaagguuaccgag

SEQ ID NO: 13425 - RNA, 27 nt, Artificial Sequence
  Synthetic oligonucleotide
aaaucaggccagggaagguuaccgagc

SEQ ID NO: 13426 - RNA, 27 nt, Artificial Sequence
  Synthetic oligonucleotide
aaucaggccagggaagguuaccgagca

SEQ ID NO: 13427 - RNA, 27 nt, Artificial Sequence
  Synthetic oligonucleotide
aucaggccagggaagguuaccgagcaa

SEQ ID NO: 13428 - RNA, 27 nt, Artificial Sequence
  Synthetic oligonucleotide
ucaggccagggaagguuaccgagcaau

SEQ ID NO: 13429 - RNA, 27 nt, Artificial Sequence
  Synthetic oligonucleotide
caggccagggaagguuaccgagcaaua

SEQ ID NO: 13430 - RNA, 27 nt, Artificial Sequence
  Synthetic oligonucleotide
aggccagggaagguuaccgagcaauag

SEQ ID NO: 13431 - RNA, 27 nt, Artificial Sequence
  Synthetic oligonucleotide
ggccagggaagguuaccgagcaauagc

SEQ ID NO: 13432 - RNA, 27 nt, Artificial Sequence
  Synthetic oligonucleotide
gccagggaagguuaccgagcaauagca

SEQ ID NO: 13433 - RNA, 27 nt, Artificial Sequence
  Synthetic oligonucleotide
ccagggaagguuaccgagcaauagcau

SEQ ID NO: 13434 - RNA, 27 nt, Artificial Sequence
  Synthetic oligonucleotide
cagggaagguuaccgagcaauagcaua

SEQ ID NO: 13435 - RNA, 27 nt, Artificial Sequence
  Synthetic oligonucleotide
agggaagguuaccgagcaauagcauac

SEQ ID NO: 13436 - RNA, 27 nt, Artificial Sequence
  Synthetic oligonucleotide
gggaagguuaccgagcaauagcauacu

SEQ ID NO: 13437 - RNA, 27 nt, Artificial Sequence
  Synthetic oligonucleotide
ggaagguuaccgagcaauagcauacuc

SEQ ID NO: 13438 - RNA, 27 nt, Artificial Sequence
  Synthetic oligonucleotide
gaagguuaccgagcaauagcauacuca

SEQ ID NO: 13439 - RNA, 27 nt, Artificial Sequence
  Synthetic oligonucleotide
agguuaccgagcaauagcauacucauc

SEQ ID NO: 13440 - RNA, 27 nt, Artificial Sequence
  Synthetic oligonucleotide
gguuaccgagcaauagcauacucaucu

SEQ ID NO: 13441 - RNA, 27 nt, Artificial Sequence
  Synthetic oligonucleotide
guuaccgagcaauagcauacucaucuc

SEQ ID NO: 13442 - RNA, 27 nt, Artificial Sequence
  Synthetic oligonucleotide
uuaccgagcaauagcauacucaucucu

SEQ ID NO: 13443 - RNA, 27 nt, Artificial Sequence
  Synthetic oligonucleotide
uaccgagcaauagcauacucaucucuc

SEQ ID NO: 13444 - RNA, 27 nt, Artificial Sequence
  Synthetic oligonucleotide
accgagcaauagcauacucaucucuca

SEQ ID NO: 13445 - RNA, 27 nt, Artificial Sequence
  Synthetic oligonucleotide
ccgagcaauagcauacucaucucucag

SEQ ID NO: 13446 - RNA, 27 nt, Artificial Sequence
  Synthetic oligonucleotide
cgagcaauagcauacucaucucucagc

SEQ ID NO: 13447 - RNA, 27 nt, Artificial Sequence
  Synthetic oligonucleotide
gagcaauagcauacucaucucucagcc

SEQ ID NO: 13448 - RNA, 27 nt, Artificial Sequence
  Synthetic oligonucleotide
agcaauagcauacucaucucucagcca

SEQ ID NO: 13449 - RNA, 27 nt, Artificial Sequence
  Synthetic oligonucleotide
gcaauagcauacucaucucucagccaa

SEQ ID NO: 13450 - RNA, 27 nt, Artificial Sequence
  Synthetic oligonucleotide
caauagcauacucaucucucagccaaa

SEQ ID NO: 13451 - RNA, 27 nt, Artificial Sequence
  Synthetic oligonucleotide
aauagcauacucaucucucagccaaag

SEQ ID NO: 13452 - RNA, 27 nt, Artificial Sequence
  Synthetic oligonucleotide
auagcauacucaucucucagccaaagu

SEQ ID NO: 13453 - RNA, 27 nt, Artificial Sequence
  Synthetic oligonucleotide
uagcauacucaucucucagccaaaguu

SEQ ID NO: 13454 - RNA, 27 nt, Artificial Sequence
  Synthetic oligonucleotide
agcauacucaucucucagccaaaguua

SEQ ID NO: 13455 - RNA, 27 nt, Artificial Sequence
  Synthetic oligonucleotide
gcauacucaucucucagccaaaguuac

SEQ ID NO: 13456 - RNA, 27 nt, Artificial Sequence
  Synthetic oligonucleotide
cauacucaucucucagccaaaguuacc

SEQ ID NO: 13457 - RNA, 27 nt, Artificial Sequence
  Synthetic oligonucleotide
auacucaucucucagccaaaguuaccu

SEQ ID NO: 13458 - RNA, 27 nt, Artificial Sequence
  Synthetic oligonucleotide
uacucaucucucagccaaaguuaccuu

SEQ ID NO: 13459 - RNA, 27 nt, Artificial Sequence
  Synthetic oligonucleotide
acucaucucucagccaaaguuaccuuu

SEQ ID NO: 13460 - RNA, 27 nt, Artificial Sequence
  Synthetic oligonucleotide
cucaucucucagccaaaguuaccuuua

SEQ ID NO: 13461 - RNA, 27 nt, Artificial Sequence
  Synthetic oligonucleotide
ucaucucucagccaaaguuaccuuuau

SEQ ID NO: 13462 - RNA, 27 nt, Artificial Sequence
  Synthetic oligonucleotide
caucucucagccaaaguuaccuuuaua

SEQ ID NO: 13463 - RNA, 27 nt, Artificial Sequence
  Synthetic oligonucleotide
aucucucagccaaaguuaccuuuauau

SEQ ID NO: 13464 - RNA, 27 nt, Artificial Sequence
  Synthetic oligonucleotide
ucucucagccaaaguuaccuuuauauu

SEQ ID NO: 13465 - RNA, 27 nt, Artificial Sequence
  Synthetic oligonucleotide
cucucagccaaaguuaccuuuauauug

SEQ ID NO: 13466 - RNA, 27 nt, Artificial Sequence
  Synthetic oligonucleotide
auaaggcuuugcuagugggagaacauc

SEQ ID NO: 13467 - RNA, 27 nt, Artificial Sequence
  Synthetic oligonucleotide
uaaggcuuugcuagugggagaacaucu

SEQ ID NO: 13468 - RNA, 27 nt, Artificial Sequence
  Synthetic oligonucleotide
aaggcuuugcuagugggagaacaucug

SEQ ID NO: 13469 - RNA, 27 nt, Artificial Sequence
  Synthetic oligonucleotide
ccccaaaagcccauauauugacaaaau

SEQ ID NO: 13470 - RNA, 27 nt, Artificial Sequence
  Synthetic oligonucleotide
cccaaaagcccauauauugacaaaaua

SEQ ID NO: 13471 - RNA, 27 nt, Artificial Sequence
  Synthetic oligonucleotide
caaaagcccauauauugacaaaauaac

SEQ ID NO: 13472 - RNA, 27 nt, Artificial Sequence
  Synthetic oligonucleotide
aaaagcccauauauugacaaaauaacu

SEQ ID NO: 13473 - RNA, 27 nt, Artificial Sequence
  Synthetic oligonucleotide
aaagcccauauauugacaaaauaacuc

SEQ ID NO: 13474 - RNA, 27 nt, Artificial Sequence
  Synthetic oligonucleotide
gcccauauauugacaaaauaacucacu

SEQ ID NO: 13475 - RNA, 27 nt, Artificial Sequence
  Synthetic oligonucleotide
auauauugacaaaauaacucacuauaa

SEQ ID NO: 13476 - RNA, 27 nt, Artificial Sequence
  Synthetic oligonucleotide
uauauugacaaaauaacucacuauaau

SEQ ID NO: 13477 - RNA, 27 nt, Artificial Sequence
  Synthetic oligonucleotide
uauugacaaaauaacucacuauaauua

SEQ ID NO: 13478 - RNA, 27 nt, Artificial Sequence
  Synthetic oligonucleotide
auuacuugauuuuauccaagggcaaaa

SEQ ID NO: 13479 - RNA, 27 nt, Artificial Sequence
  Synthetic oligonucleotide
uuacuugauuuuauccaagggcaaaau

SEQ ID NO: 13480 - RNA, 27 nt, Artificial Sequence
  Synthetic oligonucleotide
uacuugauuuuauccaagggcaaaauu

SEQ ID NO: 13481 - RNA, 27 nt, Artificial Sequence
  Synthetic oligonucleotide
acuugauuuuauccaagggcaaaauua

SEQ ID NO: 13482 - RNA, 27 nt, Artificial Sequence
  Synthetic oligonucleotide
cuugauuuuauccaagggcaaaauuau

SEQ ID NO: 13483 - RNA, 27 nt, Artificial Sequence
  Synthetic oligonucleotide
uugauuuuauccaagggcaaaauuauc

SEQ ID NO: 13484 - RNA, 27 nt, Artificial Sequence
  Synthetic oligonucleotide
ugauuuuauccaagggcaaaauuaucc

SEQ ID NO: 13485 - RNA, 27 nt, Artificial Sequence
  Synthetic oligonucleotide
gauuuuauccaagggcaaaauuaucca

SEQ ID NO: 13486 - RNA, 27 nt, Artificial Sequence
  Synthetic oligonucleotide
auuuuauccaagggcaaaauuauccac

SEQ ID NO: 13487 - RNA, 27 nt, Artificial Sequence
  Synthetic oligonucleotide
uuuuauccaagggcaaaauuauccacu

SEQ ID NO: 13488 - RNA, 27 nt, Artificial Sequence
  Synthetic oligonucleotide
uuuauccaagggcaaaauuauccacuu

SEQ ID NO: 13489 - RNA, 27 nt, Artificial Sequence
  Synthetic oligonucleotide
uuauccaagggcaaaauuauccacuuu

SEQ ID NO: 13490 - RNA, 27 nt, Artificial Sequence
  Synthetic oligonucleotide
uauccaagggcaaaauuauccacuuug

SEQ ID NO: 13491 - RNA, 27 nt, Artificial Sequence
  Synthetic oligonucleotide
auccaagggcaaaauuauccacuuugg

SEQ ID NO: 13492 - RNA, 27 nt, Artificial Sequence
  Synthetic oligonucleotide
uccaagggcaaaauuauccacuuuggc

SEQ ID NO: 13493 - RNA, 27 nt, Artificial Sequence
  Synthetic oligonucleotide
ccaagggcaaaauuauccacuuuggca

SEQ ID NO: 13494 - RNA, 27 nt, Artificial Sequence
  Synthetic oligonucleotide
caagggcaaaauuauccacuuuggcac

SEQ ID NO: 13495 - RNA, 27 nt, Artificial Sequence
  Synthetic oligonucleotide
aagggcaaaauuauccacuuuggcacg

SEQ ID NO: 13496 - RNA, 27 nt, Artificial Sequence
  Synthetic oligonucleotide
agggcaaaauuauccacuuuggcacga

SEQ ID NO: 13497 - RNA, 27 nt, Artificial Sequence
  Synthetic oligonucleotide
gggcaaaauuauccacuuuggcacgag

SEQ ID NO: 13498 - RNA, 27 nt, Artificial Sequence
  Synthetic oligonucleotide
ggcaaaauuauccacuuuggcacgagg

SEQ ID NO: 13499 - RNA, 27 nt, Artificial Sequence
  Synthetic oligonucleotide
gcaaaauuauccacuuuggcacgaggg

SEQ ID NO: 13500 - RNA, 27 nt, Artificial Sequence
  Synthetic oligonucleotide
caaaauuauccacuuuggcacgaggga

SEQ ID NO: 13501 - RNA, 27 nt, Artificial Sequence
  Synthetic oligonucleotide
auuuucagaugcaucuuaucaaaguau

SEQ ID NO: 13502 - RNA, 27 nt, Artificial Sequence
  Synthetic oligonucleotide
uuuucagaugcaucuuaucaaaguaua

SEQ ID NO: 13503 - RNA, 27 nt, Artificial Sequence
  Synthetic oligonucleotide
uuucagaugcaucuuaucaaaguauaa

SEQ ID NO: 13504 - RNA, 27 nt, Artificial Sequence
  Synthetic oligonucleotide
uucagaugcaucuuaucaaaguauaaa

SEQ ID NO: 13505 - RNA, 27 nt, Artificial Sequence
  Synthetic oligonucleotide
ucagaugcaucuuaucaaaguauaaac

SEQ ID NO: 13506 - RNA, 27 nt, Artificial Sequence
  Synthetic oligonucleotide
cagaugcaucuuaucaaaguauaaaca

SEQ ID NO: 13507 - RNA, 27 nt, Artificial Sequence
  Synthetic oligonucleotide
agaugcaucuuaucaaaguauaaacau

SEQ ID NO: 13508 - RNA, 27 nt, Artificial Sequence
  Synthetic oligonucleotide
gaugcaucuuaucaaaguauaaacauu

SEQ ID NO: 13509 - RNA, 27 nt, Artificial Sequence
  Synthetic oligonucleotide
augcaucuuaucaaaguauaaacauuc

SEQ ID NO: 13510 - RNA, 27 nt, Artificial Sequence
  Synthetic oligonucleotide
ugcaucuuaucaaaguauaaacauucc

SEQ ID NO: 13511 - RNA, 27 nt, Artificial Sequence
  Synthetic oligonucleotide
gcaucuuaucaaaguauaaacauucca

SEQ ID NO: 13512 - RNA, 27 nt, Artificial Sequence
  Synthetic oligonucleotide
caucuuaucaaaguauaaacauuccag

SEQ ID NO: 13513 - RNA, 27 nt, Artificial Sequence
  Synthetic oligonucleotide
aucuuaucaaaguauaaacauuccagu

SEQ ID NO: 13514 - RNA, 27 nt, Artificial Sequence
  Synthetic oligonucleotide
ucuuaucaaaguauaaacauuccagua

SEQ ID NO: 13515 - RNA, 27 nt, Artificial Sequence
  Synthetic oligonucleotide
cuuaucaaaguauaaacauuccaguaa

SEQ ID NO: 13516 - RNA, 27 nt, Artificial Sequence
  Synthetic oligonucleotide
uuaucaaaguauaaacauuccaguaac

SEQ ID NO: 13517 - RNA, 27 nt, Artificial Sequence
  Synthetic oligonucleotide
uaucaaaguauaaacauuccaguaaca

SEQ ID NO: 13518 - RNA, 27 nt, Artificial Sequence
  Synthetic oligonucleotide
aucaaaguauaaacauuccaguaacac

SEQ ID NO: 13519 - RNA, 27 nt, Artificial Sequence
  Synthetic oligonucleotide
cacagaacaugguuccuucaucccgac

SEQ ID NO: 13520 - RNA, 27 nt, Artificial Sequence
  Synthetic oligonucleotide
acagaacaugguuccuucaucccgacu

SEQ ID NO: 13521 - RNA, 27 nt, Artificial Sequence
  Synthetic oligonucleotide
cagaacaugguuccuucaucccgacuu

SEQ ID NO: 13522 - RNA, 27 nt, Artificial Sequence
  Synthetic oligonucleotide
agaacaugguuccuucaucccgacuuc

SEQ ID NO: 13523 - RNA, 27 nt, Artificial Sequence
  Synthetic oligonucleotide
gaacaugguuccuucaucccgacuucu

SEQ ID NO: 13524 - RNA, 27 nt, Artificial Sequence
  Synthetic oligonucleotide
aacaugguuccuucaucccgacuucug

SEQ ID NO: 13525 - RNA, 27 nt, Artificial Sequence
  Synthetic oligonucleotide
acaugguuccuucaucccgacuucugg

SEQ ID NO: 13526 - RNA, 27 nt, Artificial Sequence
  Synthetic oligonucleotide
caugguuccuucaucccgacuucuggu

SEQ ID NO: 13527 - RNA, 27 nt, Artificial Sequence
  Synthetic oligonucleotide
uucuggucuauuacaucgucacaggag

SEQ ID NO: 13528 - RNA, 27 nt, Artificial Sequence
  Synthetic oligonucleotide
ucuggucuauuacaucgucacaggaga

SEQ ID NO: 13529 - RNA, 27 nt, Artificial Sequence
  Synthetic oligonucleotide
cuggucuauuacaucgucacaggagaa

SEQ ID NO: 13530 - RNA, 27 nt, Artificial Sequence
  Synthetic oligonucleotide
uggucuauuacaucgucacaggagaac

SEQ ID NO: 13531 - RNA, 27 nt, Artificial Sequence
  Synthetic oligonucleotide
ggucuauuacaucgucacaggagaaca

SEQ ID NO: 13532 - RNA, 27 nt, Artificial Sequence
  Synthetic oligonucleotide
gucuauuacaucgucacaggagaacag

SEQ ID NO: 13533 - RNA, 27 nt, Artificial Sequence
  Synthetic oligonucleotide
ucuauuacaucgucacaggagaacaga

SEQ ID NO: 13534 - RNA, 27 nt, Artificial Sequence
  Synthetic oligonucleotide
cuauuacaucgucacaggagaacagac

SEQ ID NO: 13535 - RNA, 27 nt, Artificial Sequence
  Synthetic oligonucleotide
aacagacagcagaauuagugucugauu

SEQ ID NO: 13536 - RNA, 27 nt, Artificial Sequence
  Synthetic oligonucleotide
acagacagcagaauuagugucugauuc

SEQ ID NO: 13537 - RNA, 27 nt, Artificial Sequence
  Synthetic oligonucleotide
cagacagcagaauuagugucugauuca

SEQ ID NO: 13538 - RNA, 27 nt, Artificial Sequence
  Synthetic oligonucleotide
agacagcagaauuagugucugauucag

SEQ ID NO: 13539 - RNA, 27 nt, Artificial Sequence
  Synthetic oligonucleotide
gacagcagaauuagugucugauucagu

SEQ ID NO: 13540 - RNA, 27 nt, Artificial Sequence
  Synthetic oligonucleotide
acagcagaauuagugucugauucaguc

SEQ ID NO: 13541 - RNA, 27 nt, Artificial Sequence
  Synthetic oligonucleotide
cagcagaauuagugucugauucagucu

SEQ ID NO: 13542 - RNA, 27 nt, Artificial Sequence
  Synthetic oligonucleotide
agcagaauuagugucugauucagucug

SEQ ID NO: 13543 - RNA, 27 nt, Artificial Sequence
  Synthetic oligonucleotide
gcagaauuagugucugauucagucugg

SEQ ID NO: 13544 - RNA, 27 nt, Artificial Sequence
  Synthetic oligonucleotide
cagaauuagugucugauucagucuggu

SEQ ID NO: 13545 - RNA, 27 nt, Artificial Sequence
  Synthetic oligonucleotide
agaauuagugucugauucagucugguu

SEQ ID NO: 13546 - RNA, 27 nt, Artificial Sequence
  Synthetic oligonucleotide
gaauuagugucugauucagucugguua

SEQ ID NO: 13547 - RNA, 27 nt, Artificial Sequence
  Synthetic oligonucleotide
aauuagugucugauucagucugguuaa

SEQ ID NO: 13548 - RNA, 27 nt, Artificial Sequence
  Synthetic oligonucleotide
auuagugucugauucagucugguuaaa

SEQ ID NO: 13549 - RNA, 27 nt, Artificial Sequence
  Synthetic oligonucleotide
uuagugucugauucagucugguuaaau

SEQ ID NO: 13550 - RNA, 27 nt, Artificial Sequence
  Synthetic oligonucleotide
uagugucugauucagucugguuaaaua

SEQ ID NO: 13551 - RNA, 27 nt, Artificial Sequence
  Synthetic oligonucleotide
agugucugauucagucugguuaaauau

SEQ ID NO: 13552 - RNA, 27 nt, Artificial Sequence
  Synthetic oligonucleotide
ugucugauucagucugguuaaauauug

SEQ ID NO: 13553 - RNA, 27 nt, Artificial Sequence
  Synthetic oligonucleotide
gauucagucugguuaaauauugaagaa

SEQ ID NO: 13554 - RNA, 27 nt, Artificial Sequence
  Synthetic oligonucleotide
ugguuaaauauugaagaaaaauguggc

SEQ ID NO: 13555 - RNA, 27 nt, Artificial Sequence
  Synthetic oligonucleotide
gguuaaauauugaagaaaaauguggca

SEQ ID NO: 13556 - RNA, 27 nt, Artificial Sequence
  Synthetic oligonucleotide
guuaaauauugaagaaaaauguggcaa

SEQ ID NO: 13557 - RNA, 27 nt, Artificial Sequence
  Synthetic oligonucleotide
uuaaauauugaagaaaaauguggcaac

SEQ ID NO: 13558 - RNA, 27 nt, Artificial Sequence
  Synthetic oligonucleotide
uaaauauugaagaaaaauguggcaacc

SEQ ID NO: 13559 - RNA, 27 nt, Artificial Sequence
  Synthetic oligonucleotide
aaauauugaagaaaaauguggcaacca

SEQ ID NO: 13560 - RNA, 27 nt, Artificial Sequence
  Synthetic oligonucleotide
aauauugaagaaaaauguggcaaccag

SEQ ID NO: 13561 - RNA, 27 nt, Artificial Sequence
  Synthetic oligonucleotide
auauugaagaaaaauguggcaaccagc

SEQ ID NO: 13562 - RNA, 27 nt, Artificial Sequence
  Synthetic oligonucleotide
uauugaagaaaaauguggcaaccagcu

SEQ ID NO: 13563 - RNA, 27 nt, Artificial Sequence
  Synthetic oligonucleotide
auugaagaaaaauguggcaaccagcuc

SEQ ID NO: 13564 - RNA, 27 nt, Artificial Sequence
  Synthetic oligonucleotide
uugaagaaaaauguggcaaccagcucc

SEQ ID NO: 13565 - RNA, 27 nt, Artificial Sequence
  Synthetic oligonucleotide
ugaagaaaaauguggcaaccagcucca

SEQ ID NO: 13566 - RNA, 27 nt, Artificial Sequence
  Synthetic oligonucleotide
gaagaaaaauguggcaaccagcuccag

SEQ ID NO: 13567 - RNA, 27 nt, Artificial Sequence
  Synthetic oligonucleotide
aagaaaaauguggcaaccagcuccagg

SEQ ID NO: 13568 - RNA, 27 nt, Artificial Sequence
  Synthetic oligonucleotide
agaaaaauguggcaaccagcuccaggu

SEQ ID NO: 13569 - RNA, 27 nt, Artificial Sequence
  Synthetic oligonucleotide
gaaaaauguggcaaccagcuccagguu

SEQ ID NO: 13570 - RNA, 27 nt, Artificial Sequence
  Synthetic oligonucleotide
aaaaauguggcaaccagcuccagguuc

SEQ ID NO: 13571 - RNA, 27 nt, Artificial Sequence
  Synthetic oligonucleotide
aaaauguggcaaccagcuccagguuca

SEQ ID NO: 13572 - RNA, 27 nt, Artificial Sequence
  Synthetic oligonucleotide
aaauguggcaaccagcuccagguucau

SEQ ID NO: 13573 - RNA, 27 nt, Artificial Sequence
  Synthetic oligonucleotide
uguggcaaccagcuccagguucaucug

SEQ ID NO: 13574 - RNA, 27 nt, Artificial Sequence
  Synthetic oligonucleotide
guggcaaccagcuccagguucaucugu

SEQ ID NO: 13575 - RNA, 27 nt, Artificial Sequence
  Synthetic oligonucleotide
uggcaaccagcuccagguucaucuguc

SEQ ID NO: 13576 - RNA, 27 nt, Artificial Sequence
  Synthetic oligonucleotide
ggcaaccagcuccagguucaucugucu

SEQ ID NO: 13577 - RNA, 27 nt, Artificial Sequence
  Synthetic oligonucleotide
gcaaccagcuccagguucaucugucuc

SEQ ID NO: 13578 - RNA, 27 nt, Artificial Sequence
  Synthetic oligonucleotide
caaccagcuccagguucaucugucucc

SEQ ID NO: 13579 - RNA, 27 nt, Artificial Sequence
  Synthetic oligonucleotide
aaccagcuccagguucaucugucuccu

SEQ ID NO: 13580 - RNA, 27 nt, Artificial Sequence
  Synthetic oligonucleotide
accagcuccagguucaucugucuccug

SEQ ID NO: 13581 - RNA, 27 nt, Artificial Sequence
  Synthetic oligonucleotide
ccagcuccagguucaucugucuccuga

SEQ ID NO: 13582 - RNA, 27 nt, Artificial Sequence
  Synthetic oligonucleotide
cagcuccagguucaucugucuccugau

SEQ ID NO: 13583 - RNA, 27 nt, Artificial Sequence
  Synthetic oligonucleotide
agcuccagguucaucugucuccugaug

SEQ ID NO: 13584 - RNA, 27 nt, Artificial Sequence
  Synthetic oligonucleotide
gcuccagguucaucugucuccugaugc

SEQ ID NO: 13585 - RNA, 27 nt, Artificial Sequence
  Synthetic oligonucleotide
cuccagguucaucugucuccugaugca

SEQ ID NO: 13586 - RNA, 27 nt, Artificial Sequence
  Synthetic oligonucleotide
uccagguucaucugucuccugaugcag

SEQ ID NO: 13587 - RNA, 27 nt, Artificial Sequence
  Synthetic oligonucleotide
ccagguucaucugucuccugaugcaga

SEQ ID NO: 13588 - RNA, 27 nt, Artificial Sequence
  Synthetic oligonucleotide
cagguucaucugucuccugaugcagau

SEQ ID NO: 13589 - RNA, 27 nt, Artificial Sequence
  Synthetic oligonucleotide
agguucaucugucuccugaugcagaug

SEQ ID NO: 13590 - RNA, 27 nt, Artificial Sequence
  Synthetic oligonucleotide
gguucaucugucuccugaugcagaugc

SEQ ID NO: 13591 - RNA, 27 nt, Artificial Sequence
  Synthetic oligonucleotide
guucaucugucuccugaugcagaugca

SEQ ID NO: 13592 - RNA, 27 nt, Artificial Sequence
  Synthetic oligonucleotide
uucaucugucuccugaugcagaugcau

SEQ ID NO: 13593 - RNA, 27 nt, Artificial Sequence
  Synthetic oligonucleotide
ucaucugucuccugaugcagaugcaua

SEQ ID NO: 13594 - RNA, 27 nt, Artificial Sequence
  Synthetic oligonucleotide
caucugucuccugaugcagaugcauau

SEQ ID NO: 13595 - RNA, 27 nt, Artificial Sequence
  Synthetic oligonucleotide
gaauggauuccuggguggcauuagcag

SEQ ID NO: 13596 - RNA, 27 nt, Artificial Sequence
  Synthetic oligonucleotide
aauggauuccuggguggcauuagcagc

SEQ ID NO: 13597 - RNA, 27 nt, Artificial Sequence
  Synthetic oligonucleotide
auggauuccuggguggcauuagcagca

SEQ ID NO: 13598 - RNA, 27 nt, Artificial Sequence
  Synthetic oligonucleotide
aggagccaaaaagcccuuggaaagagu

SEQ ID NO: 13599 - RNA, 27 nt, Artificial Sequence
  Synthetic oligonucleotide
ggagccaaaaagcccuuggaaagagua

SEQ ID NO: 13600 - RNA, 27 nt, Artificial Sequence
  Synthetic oligonucleotide
gagccaaaaagcccuuggaaagaguau

SEQ ID NO: 13601 - RNA, 27 nt, Artificial Sequence
  Synthetic oligonucleotide
agccaaaaagcccuuggaaagaguauu

SEQ ID NO: 13602 - RNA, 27 nt, Artificial Sequence
  Synthetic oligonucleotide
gccaaaaagcccuuggaaagaguauuu

SEQ ID NO: 13603 - RNA, 27 nt, Artificial Sequence
  Synthetic oligonucleotide
ccaaaaagcccuuggaaagaguauuuc

SEQ ID NO: 13604 - RNA, 27 nt, Artificial Sequence
  Synthetic oligonucleotide
caaaaagcccuuggaaagaguauuuca

SEQ ID NO: 13605 - RNA, 27 nt, Artificial Sequence
  Synthetic oligonucleotide
aaaaagcccuuggaaagaguauuucaa

SEQ ID NO: 13606 - RNA, 27 nt, Artificial Sequence
  Synthetic oligonucleotide
aaaagcccuuggaaagaguauuucaau

SEQ ID NO: 13607 - RNA, 27 nt, Artificial Sequence
  Synthetic oligonucleotide
aaagcccuuggaaagaguauuucaauu

SEQ ID NO: 13608 - RNA, 27 nt, Artificial Sequence
  Synthetic oligonucleotide
aagcccuuggaaagaguauuucaauuc

SEQ ID NO: 13609 - RNA, 27 nt, Artificial Sequence
  Synthetic oligonucleotide
agcccuuggaaagaguauuucaauucu

SEQ ID NO: 13610 - RNA, 27 nt, Artificial Sequence
  Synthetic oligonucleotide
gcccuuggaaagaguauuucaauucuu

SEQ ID NO: 13611 - RNA, 27 nt, Artificial Sequence
  Synthetic oligonucleotide
cccuuggaaagaguauuucaauucuua

SEQ ID NO: 13612 - RNA, 27 nt, Artificial Sequence
  Synthetic oligonucleotide
ccuuggaaagaguauuucaauucuuag

SEQ ID NO: 13613 - RNA, 27 nt, Artificial Sequence
  Synthetic oligonucleotide
cuuggaaagaguauuucaauucuuaga

SEQ ID NO: 13614 - RNA, 27 nt, Artificial Sequence
  Synthetic oligonucleotide
uuggaaagaguauuucaauucuuagag

SEQ ID NO: 13615 - RNA, 27 nt, Artificial Sequence
  Synthetic oligonucleotide
uggaaagaguauuucaauucuuagaga

SEQ ID NO: 13616 - RNA, 27 nt, Artificial Sequence
  Synthetic oligonucleotide
ggaaagaguauuucaauucuuagagaa

SEQ ID NO: 13617 - RNA, 27 nt, Artificial Sequence
  Synthetic oligonucleotide
gaaagaguauuucaauucuuagagaag

SEQ ID NO: 13618 - RNA, 27 nt, Artificial Sequence
  Synthetic oligonucleotide
aaagaguauuucaauucuuagagaaga

SEQ ID NO: 13619 - RNA, 27 nt, Artificial Sequence
  Synthetic oligonucleotide
aagaguauuucaauucuuagagaagag

SEQ ID NO: 13620 - RNA, 27 nt, Artificial Sequence
  Synthetic oligonucleotide
agaguauuucaauucuuagagaagagu

SEQ ID NO: 13621 - RNA, 27 nt, Artificial Sequence
  Synthetic oligonucleotide
gaguauuucaauucuuagagaagagug

SEQ ID NO: 13622 - RNA, 27 nt, Artificial Sequence
  Synthetic oligonucleotide
aguauuucaauucuuagagaagaguga

SEQ ID NO: 13623 - RNA, 27 nt, Artificial Sequence
  Synthetic oligonucleotide
guauuucaauucuuagagaagagugau

SEQ ID NO: 13624 - RNA, 27 nt, Artificial Sequence
  Synthetic oligonucleotide
uauuucaauucuuagagaagagugauc

SEQ ID NO: 13625 - RNA, 27 nt, Artificial Sequence
  Synthetic oligonucleotide
auuucaauucuuagagaagagugaucu

SEQ ID NO: 13626 - RNA, 27 nt, Artificial Sequence
  Synthetic oligonucleotide
uuucaauucuuagagaagagugaucug

SEQ ID NO: 13627 - RNA, 27 nt, Artificial Sequence
  Synthetic oligonucleotide
uucaauucuuagagaagagugaucugg

SEQ ID NO: 13628 - RNA, 27 nt, Artificial Sequence
  Synthetic oligonucleotide
ucaauucuuagagaagagugaucuggg

SEQ ID NO: 13629 - RNA, 27 nt, Artificial Sequence
  Synthetic oligonucleotide
caauucuuagagaagagugaucugggc

SEQ ID NO: 13630 - RNA, 27 nt, Artificial Sequence
  Synthetic oligonucleotide
aauucuuagagaagagugaucugggcu

SEQ ID NO: 13631 - RNA, 27 nt, Artificial Sequence
  Synthetic oligonucleotide
uucuuagagaagagugaucugggcugu

SEQ ID NO: 13632 - RNA, 27 nt, Artificial Sequence
  Synthetic oligonucleotide
ucuuagagaagagugaucugggcugug

SEQ ID NO: 13633 - RNA, 27 nt, Artificial Sequence
  Synthetic oligonucleotide
uuagagaagagugaucugggcuguggg

SEQ ID NO: 13634 - RNA, 27 nt, Artificial Sequence
  Synthetic oligonucleotide
uguggggcaggugguggccucaacaau

SEQ ID NO: 13635 - RNA, 27 nt, Artificial Sequence
  Synthetic oligonucleotide
gggcaggugguggccucaacaaugcca

SEQ ID NO: 13636 - RNA, 27 nt, Artificial Sequence
  Synthetic oligonucleotide
ggcaggugguggccucaacaaugccaa

SEQ ID NO: 13637 - RNA, 27 nt, Artificial Sequence
  Synthetic oligonucleotide
gcaggugguggccucaacaaugccaau

SEQ ID NO: 13638 - RNA, 27 nt, Artificial Sequence
  Synthetic oligonucleotide
caggugguggccucaacaaugccaaug

SEQ ID NO: 13639 - RNA, 27 nt, Artificial Sequence
  Synthetic oligonucleotide
aggugguggccucaacaaugccaaugu

SEQ ID NO: 13640 - RNA, 27 nt, Artificial Sequence
  Synthetic oligonucleotide
ggugguggccucaacaaugccaaugug

SEQ ID NO: 13641 - RNA, 27 nt, Artificial Sequence
  Synthetic oligonucleotide
guguuccaccuagcuggacuuaccuuc

SEQ ID NO: 13642 - RNA, 27 nt, Artificial Sequence
  Synthetic oligonucleotide
uguuccaccuagcuggacuuaccuucc

SEQ ID NO: 13643 - RNA, 27 nt, Artificial Sequence
  Synthetic oligonucleotide
guuccaccuagcuggacuuaccuuccu

SEQ ID NO: 13644 - RNA, 27 nt, Artificial Sequence
  Synthetic oligonucleotide
uuccaccuagcuggacuuaccuuccuc

SEQ ID NO: 13645 - RNA, 27 nt, Artificial Sequence
  Synthetic oligonucleotide
uccaccuagcuggacuuaccuuccuca

SEQ ID NO: 13646 - RNA, 27 nt, Artificial Sequence
  Synthetic oligonucleotide
ccaccuagcuggacuuaccuuccucac

SEQ ID NO: 13647 - RNA, 27 nt, Artificial Sequence
  Synthetic oligonucleotide
caccuagcuggacuuaccuuccucacu

SEQ ID NO: 13648 - RNA, 27 nt, Artificial Sequence
  Synthetic oligonucleotide
accuagcuggacuuaccuuccucacua

SEQ ID NO: 13649 - RNA, 27 nt, Artificial Sequence
  Synthetic oligonucleotide
ccuagcuggacuuaccuuccucacuaa

SEQ ID NO: 13650 - RNA, 27 nt, Artificial Sequence
  Synthetic oligonucleotide
cuagcuggacuuaccuuccucacuaau

SEQ ID NO: 13651 - RNA, 27 nt, Artificial Sequence
  Synthetic oligonucleotide
uagcuggacuuaccuuccucacuaaug

SEQ ID NO: 13652 - RNA, 27 nt, Artificial Sequence
  Synthetic oligonucleotide
agcuggacuuaccuuccucacuaaugc

SEQ ID NO: 13653 - RNA, 27 nt, Artificial Sequence
  Synthetic oligonucleotide
gcuggacuuaccuuccucacuaaugca

SEQ ID NO: 13654 - RNA, 27 nt, Artificial Sequence
  Synthetic oligonucleotide
cuggacuuaccuuccucacuaaugcaa

SEQ ID NO: 13655 - RNA, 27 nt, Artificial Sequence
  Synthetic oligonucleotide
uggacuuaccuuccucacuaaugcaaa

SEQ ID NO: 13656 - RNA, 27 nt, Artificial Sequence
  Synthetic oligonucleotide
ggacuuaccuuccucacuaaugcaaau

SEQ ID NO: 13657 - RNA, 27 nt, Artificial Sequence
  Synthetic oligonucleotide
gacuuaccuuccucacuaaugcaaaug

SEQ ID NO: 13658 - RNA, 27 nt, Artificial Sequence
  Synthetic oligonucleotide
acuuaccuuccucacuaaugcaaaugc

SEQ ID NO: 13659 - RNA, 27 nt, Artificial Sequence
  Synthetic oligonucleotide
cuuaccuuccucacuaaugcaaaugca

SEQ ID NO: 13660 - RNA, 27 nt, Artificial Sequence
  Synthetic oligonucleotide
uuaccuuccucacuaaugcaaaugcag

SEQ ID NO: 13661 - RNA, 27 nt, Artificial Sequence
  Synthetic oligonucleotide
uaccuuccucacuaaugcaaaugcaga

SEQ ID NO: 13662 - RNA, 27 nt, Artificial Sequence
  Synthetic oligonucleotide
accuuccucacuaaugcaaaugcagau

SEQ ID NO: 13663 - RNA, 27 nt, Artificial Sequence
  Synthetic oligonucleotide
ccuuccucacuaaugcaaaugcagaug

SEQ ID NO: 13664 - RNA, 27 nt, Artificial Sequence
  Synthetic oligonucleotide
cuuccucacuaaugcaaaugcagauga

SEQ ID NO: 13665 - RNA, 27 nt, Artificial Sequence
  Synthetic oligonucleotide
uuccucacuaaugcaaaugcagaugac

SEQ ID NO: 13666 - RNA, 27 nt, Artificial Sequence
  Synthetic oligonucleotide
uccucacuaaugcaaaugcagaugacu

SEQ ID NO: 13667 - RNA, 27 nt, Artificial Sequence
  Synthetic oligonucleotide
ccucacuaaugcaaaugcagaugacuc

SEQ ID NO: 13668 - RNA, 27 nt, Artificial Sequence
  Synthetic oligonucleotide
cucacuaaugcaaaugcagaugacucc

SEQ ID NO: 13669 - RNA, 27 nt, Artificial Sequence
  Synthetic oligonucleotide
ucacuaaugcaaaugcagaugacuccc

SEQ ID NO: 13670 - RNA, 27 nt, Artificial Sequence
  Synthetic oligonucleotide
cacuaaugcaaaugcagaugacuccca

SEQ ID NO: 13671 - RNA, 27 nt, Artificial Sequence
  Synthetic oligonucleotide
acuaaugcaaaugcagaugacucccaa

SEQ ID NO: 13672 - RNA, 27 nt, Artificial Sequence
  Synthetic oligonucleotide
cuaaugcaaaugcagaugacucccaag

SEQ ID NO: 13673 - RNA, 27 nt, Artificial Sequence
  Synthetic oligonucleotide
uaaugcaaaugcagaugacucccaaga

SEQ ID NO: 13674 - RNA, 27 nt, Artificial Sequence
  Synthetic oligonucleotide
aaugcaaaugcagaugacucccaagaa

SEQ ID NO: 13675 - RNA, 27 nt, Artificial Sequence
  Synthetic oligonucleotide
augcaaaugcagaugacucccaagaaa

SEQ ID NO: 13676 - RNA, 27 nt, Artificial Sequence
  Synthetic oligonucleotide
ugcaaaugcagaugacucccaagaaaa

SEQ ID NO: 13677 - RNA, 27 nt, Artificial Sequence
  Synthetic oligonucleotide
gcaaaugcagaugacucccaagaaaau

SEQ ID NO: 13678 - RNA, 27 nt, Artificial Sequence
  Synthetic oligonucleotide
caaaugcagaugacucccaagaaaaug

SEQ ID NO: 13679 - RNA, 27 nt, Artificial Sequence
  Synthetic oligonucleotide
aaaugcagaugacucccaagaaaauga

SEQ ID NO: 13680 - RNA, 27 nt, Artificial Sequence
  Synthetic oligonucleotide
aaugcagaugacucccaagaaaaugau

SEQ ID NO: 13681 - RNA, 27 nt, Artificial Sequence
  Synthetic oligonucleotide
augcagaugacucccaagaaaaugaug

SEQ ID NO: 13682 - RNA, 27 nt, Artificial Sequence
  Synthetic oligonucleotide
ugcagaugacucccaagaaaaugauga

SEQ ID NO: 13683 - RNA, 27 nt, Artificial Sequence
  Synthetic oligonucleotide
gcagaugacucccaagaaaaugaugaa

SEQ ID NO: 13684 - RNA, 27 nt, Artificial Sequence
  Synthetic oligonucleotide
cagaugacucccaagaaaaugaugaac

SEQ ID NO: 13685 - RNA, 27 nt, Artificial Sequence
  Synthetic oligonucleotide
agaugacucccaagaaaaugaugaacc

SEQ ID NO: 13686 - RNA, 27 nt, Artificial Sequence
  Synthetic oligonucleotide
gaugacucccaagaaaaugaugaaccu

SEQ ID NO: 13687 - RNA, 27 nt, Artificial Sequence
  Synthetic oligonucleotide
augacucccaagaaaaugaugaaccuu

SEQ ID NO: 13688 - RNA, 27 nt, Artificial Sequence
  Synthetic oligonucleotide
ugacucccaagaaaaugaugaaccuug

SEQ ID NO: 13689 - RNA, 27 nt, Artificial Sequence
  Synthetic oligonucleotide
gacucccaagaaaaugaugaaccuugu

SEQ ID NO: 13690 - RNA, 27 nt, Artificial Sequence
  Synthetic oligonucleotide
acucccaagaaaaugaugaaccuugua

SEQ ID NO: 13691 - RNA, 27 nt, Artificial Sequence
  Synthetic oligonucleotide
cucccaagaaaaugaugaaccuuguaa

SEQ ID NO: 13692 - RNA, 27 nt, Artificial Sequence
  Synthetic oligonucleotide
ucccaagaaaaugaugaaccuuguaaa

SEQ ID NO: 13693 - RNA, 27 nt, Artificial Sequence
  Synthetic oligonucleotide
cccaagaaaaugaugaaccuuguaaag

SEQ ID NO: 13694 - RNA, 27 nt, Artificial Sequence
  Synthetic oligonucleotide
ccaagaaaaugaugaaccuuguaaaga

SEQ ID NO: 13695 - RNA, 27 nt, Artificial Sequence
  Synthetic oligonucleotide
aagaaaaugaugaaccuuguaaagaaa

SEQ ID NO: 13696 - RNA, 27 nt, Artificial Sequence
  Synthetic oligonucleotide
agaaaaugaugaaccuuguaaagaaau

SEQ ID NO: 13697 - RNA, 27 nt, Artificial Sequence
  Synthetic oligonucleotide
gaaaaugaugaaccuuguaaagaaauu

SEQ ID NO: 13698 - RNA, 27 nt, Artificial Sequence
  Synthetic oligonucleotide
aaaaugaugaaccuuguaaagaaauuc

SEQ ID NO: 13699 - RNA, 27 nt, Artificial Sequence
  Synthetic oligonucleotide
aaugaugaaccuuguaaagaaauucuc

SEQ ID NO: 13700 - RNA, 27 nt, Artificial Sequence
  Synthetic oligonucleotide
gaugaaccuuguaaagaaauucucagg

SEQ ID NO: 13701 - RNA, 27 nt, Artificial Sequence
  Synthetic oligonucleotide
aaagaagauagaagaaauagcugcuaa

SEQ ID NO: 13702 - RNA, 27 nt, Artificial Sequence
  Synthetic oligonucleotide
aagaagauagaagaaauagcugcuaaa

SEQ ID NO: 13703 - RNA, 27 nt, Artificial Sequence
  Synthetic oligonucleotide
agaagauagaagaaauagcugcuaaau

SEQ ID NO: 13704 - RNA, 27 nt, Artificial Sequence
  Synthetic oligonucleotide
gaagauagaagaaauagcugcuaaaua

SEQ ID NO: 13705 - RNA, 27 nt, Artificial Sequence
  Synthetic oligonucleotide
aagauagaagaaauagcugcuaaauau

SEQ ID NO: 13706 - RNA, 27 nt, Artificial Sequence
  Synthetic oligonucleotide
agauagaagaaauagcugcuaaauaua

SEQ ID NO: 13707 - RNA, 27 nt, Artificial Sequence
  Synthetic oligonucleotide
gauagaagaaauagcugcuaaauauaa

SEQ ID NO: 13708 - RNA, 27 nt, Artificial Sequence
  Synthetic oligonucleotide
auagaagaaauagcugcuaaauauaaa

SEQ ID NO: 13709 - RNA, 27 nt, Artificial Sequence
  Synthetic oligonucleotide
uagaagaaauagcugcuaaauauaaac

SEQ ID NO: 13710 - RNA, 27 nt, Artificial Sequence
  Synthetic oligonucleotide
agaagaaauagcugcuaaauauaaaca

SEQ ID NO: 13711 - RNA, 27 nt, Artificial Sequence
  Synthetic oligonucleotide
gaagaaauagcugcuaaauauaaacau

SEQ ID NO: 13712 - RNA, 27 nt, Artificial Sequence
  Synthetic oligonucleotide
aagaaauagcugcuaaauauaaacauu

SEQ ID NO: 13713 - RNA, 27 nt, Artificial Sequence
  Synthetic oligonucleotide
agaaauagcugcuaaauauaaacauuc

SEQ ID NO: 13714 - RNA, 27 nt, Artificial Sequence
  Synthetic oligonucleotide
gaaauagcugcuaaauauaaacauuca

SEQ ID NO: 13715 - RNA, 27 nt, Artificial Sequence
  Synthetic oligonucleotide
aaauagcugcuaaauauaaacauucag

SEQ ID NO: 13716 - RNA, 27 nt, Artificial Sequence
  Synthetic oligonucleotide
aauagcugcuaaauauaaacauucagu

SEQ ID NO: 13717 - RNA, 27 nt, Artificial Sequence
  Synthetic oligonucleotide
auagcugcuaaauauaaacauucagua

SEQ ID NO: 13718 - RNA, 27 nt, Artificial Sequence
  Synthetic oligonucleotide
uagcugcuaaauauaaacauucaguag

SEQ ID NO: 13719 - RNA, 27 nt, Artificial Sequence
  Synthetic oligonucleotide
aguagugaagaaauguuguuacgaugg

SEQ ID NO: 13720 - RNA, 27 nt, Artificial Sequence
  Synthetic oligonucleotide
guagugaagaaauguuguuacgaugga

SEQ ID NO: 13721 - RNA, 27 nt, Artificial Sequence
  Synthetic oligonucleotide
uagugaagaaauguuguuacgauggag

SEQ ID NO: 13722 - RNA, 27 nt, Artificial Sequence
  Synthetic oligonucleotide
agugaagaaauguuguuacgauggagc

SEQ ID NO: 13723 - RNA, 27 nt, Artificial Sequence
  Synthetic oligonucleotide
gugaagaaauguuguuacgauggagcc

SEQ ID NO: 13724 - RNA, 27 nt, Artificial Sequence
  Synthetic oligonucleotide
ugaagaaauguuguuacgauggagccu

SEQ ID NO: 13725 - RNA, 27 nt, Artificial Sequence
  Synthetic oligonucleotide
gaagaaauguuguuacgauggagccug

SEQ ID NO: 13726 - RNA, 27 nt, Artificial Sequence
  Synthetic oligonucleotide
aagaaauguuguuacgauggagccugc

SEQ ID NO: 13727 - RNA, 27 nt, Artificial Sequence
  Synthetic oligonucleotide
agaaauguuguuacgauggagccugcg

SEQ ID NO: 13728 - RNA, 27 nt, Artificial Sequence
  Synthetic oligonucleotide
uaaugaugaaaccugugagcagcgagc

SEQ ID NO: 13729 - RNA, 27 nt, Artificial Sequence
  Synthetic oligonucleotide
aaugaugaaaccugugagcagcgagcu

SEQ ID NO: 13730 - RNA, 27 nt, Artificial Sequence
  Synthetic oligonucleotide
augaugaaaccugugagcagcgagcug

SEQ ID NO: 13731 - RNA, 27 nt, Artificial Sequence
  Synthetic oligonucleotide
ugaugaaaccugugagcagcgagcugc

SEQ ID NO: 13732 - RNA, 27 nt, Artificial Sequence
  Synthetic oligonucleotide
gaugaaaccugugagcagcgagcugca

SEQ ID NO: 13733 - RNA, 27 nt, Artificial Sequence
  Synthetic oligonucleotide
augaaaccugugagcagcgagcugcac

SEQ ID NO: 13734 - RNA, 27 nt, Artificial Sequence
  Synthetic oligonucleotide
ugaaaccugugagcagcgagcugcacg

SEQ ID NO: 13735 - RNA, 27 nt, Artificial Sequence
  Synthetic oligonucleotide
aaccugugagcagcgagcugcacggau

SEQ ID NO: 13736 - RNA, 27 nt, Artificial Sequence
  Synthetic oligonucleotide
accugugagcagcgagcugcacggauu

SEQ ID NO: 13737 - RNA, 27 nt, Artificial Sequence
  Synthetic oligonucleotide
ccugugagcagcgagcugcacggauua

SEQ ID NO: 13738 - RNA, 27 nt, Artificial Sequence
  Synthetic oligonucleotide
cugugagcagcgagcugcacggauuag

SEQ ID NO: 13739 - RNA, 27 nt, Artificial Sequence
  Synthetic oligonucleotide
ugugagcagcgagcugcacggauuagu

SEQ ID NO: 13740 - RNA, 27 nt, Artificial Sequence
  Synthetic oligonucleotide
gugagcagcgagcugcacggauuaguu

SEQ ID NO: 13741 - RNA, 27 nt, Artificial Sequence
  Synthetic oligonucleotide
ugagcagcgagcugcacggauuaguuu

SEQ ID NO: 13742 - RNA, 27 nt, Artificial Sequence
  Synthetic oligonucleotide
gagcagcgagcugcacggauuaguuua

SEQ ID NO: 13743 - RNA, 27 nt, Artificial Sequence
  Synthetic oligonucleotide
agcagcgagcugcacggauuaguuuag

SEQ ID NO: 13744 - RNA, 27 nt, Artificial Sequence
  Synthetic oligonucleotide
gcagcgagcugcacggauuaguuuagg

SEQ ID NO: 13745 - RNA, 27 nt, Artificial Sequence
  Synthetic oligonucleotide
cagcgagcugcacggauuaguuuaggg

SEQ ID NO: 13746 - RNA, 27 nt, Artificial Sequence
  Synthetic oligonucleotide
gugucgucgcaagccagcuccgugcua

SEQ ID NO: 13747 - RNA, 27 nt, Artificial Sequence
  Synthetic oligonucleotide
ugucgucgcaagccagcuccgugcuaa

SEQ ID NO: 13748 - RNA, 27 nt, Artificial Sequence
  Synthetic oligonucleotide
gucgucgcaagccagcuccgugcuaau

SEQ ID NO: 13749 - RNA, 27 nt, Artificial Sequence
  Synthetic oligonucleotide
ucgucgcaagccagcuccgugcuaaua

SEQ ID NO: 13750 - RNA, 27 nt, Artificial Sequence
  Synthetic oligonucleotide
cgucgcaagccagcuccgugcuaauau

SEQ ID NO: 13751 - RNA, 27 nt, Artificial Sequence
  Synthetic oligonucleotide
gucgcaagccagcuccgugcuaauauc

SEQ ID NO: 13752 - RNA, 27 nt, Artificial Sequence
  Synthetic oligonucleotide
ucgcaagccagcuccgugcuaauaucu

SEQ ID NO: 13753 - RNA, 27 nt, Artificial Sequence
  Synthetic oligonucleotide
cgcaagccagcuccgugcuaauaucuc

SEQ ID NO: 13754 - RNA, 27 nt, Artificial Sequence
  Synthetic oligonucleotide
gcaagccagcuccgugcuaauaucucu

SEQ ID NO: 13755 - RNA, 27 nt, Artificial Sequence
  Synthetic oligonucleotide
caagccagcuccgugcuaauaucucuc

SEQ ID NO: 13756 - RNA, 27 nt, Artificial Sequence
  Synthetic oligonucleotide
cacaugaagacccuguuaccaguaagc

SEQ ID NO: 13757 - RNA, 27 nt, Artificial Sequence
  Synthetic oligonucleotide
acaugaagacccuguuaccaguaagca

SEQ ID NO: 13758 - RNA, 27 nt, Artificial Sequence
  Synthetic oligonucleotide
caugaagacccuguuaccaguaagcaa

SEQ ID NO: 13759 - RNA, 27 nt, Artificial Sequence
  Synthetic oligonucleotide
ugaagacccuguuaccaguaagcaagc

SEQ ID NO: 13760 - RNA, 27 nt, Artificial Sequence
  Synthetic oligonucleotide
gaagacccuguuaccaguaagcaagcc

SEQ ID NO: 13761 - RNA, 27 nt, Artificial Sequence
  Synthetic oligonucleotide
aagacccuguuaccaguaagcaagcca

SEQ ID NO: 13762 - RNA, 27 nt, Artificial Sequence
  Synthetic oligonucleotide
agacccuguuaccaguaagcaagccag

SEQ ID NO: 13763 - RNA, 27 nt, Artificial Sequence
  Synthetic oligonucleotide
gacccuguuaccaguaagcaagccaga

SEQ ID NO: 13764 - RNA, 27 nt, Artificial Sequence
  Synthetic oligonucleotide
acccuguuaccaguaagcaagccagaa

SEQ ID NO: 13765 - RNA, 27 nt, Artificial Sequence
  Synthetic oligonucleotide
cccuguuaccaguaagcaagccagaaa

SEQ ID NO: 13766 - RNA, 27 nt, Artificial Sequence
  Synthetic oligonucleotide
ccuguuaccaguaagcaagccagaaau

SEQ ID NO: 13767 - RNA, 27 nt, Artificial Sequence
  Synthetic oligonucleotide
cuguuaccaguaagcaagccagaaauu

SEQ ID NO: 13768 - RNA, 27 nt, Artificial Sequence
  Synthetic oligonucleotide
uguuaccaguaagcaagccagaaauuc

SEQ ID NO: 13769 - RNA, 27 nt, Artificial Sequence
  Synthetic oligonucleotide
guuaccaguaagcaagccagaaauucg

SEQ ID NO: 13770 - RNA, 27 nt, Artificial Sequence
  Synthetic oligonucleotide
uuaccaguaagcaagccagaaauucgg

SEQ ID NO: 13771 - RNA, 27 nt, Artificial Sequence
  Synthetic oligonucleotide
uaccaguaagcaagccagaaauucgga

SEQ ID NO: 13772 - RNA, 27 nt, Artificial Sequence
  Synthetic oligonucleotide
accaguaagcaagccagaaauucggag

SEQ ID NO: 13773 - RNA, 27 nt, Artificial Sequence
  Synthetic oligonucleotide
ccaguaagcaagccagaaauucggagu

SEQ ID NO: 13774 - RNA, 27 nt, Artificial Sequence
  Synthetic oligonucleotide
caguaagcaagccagaaauucggaguu

SEQ ID NO: 13775 - RNA, 27 nt, Artificial Sequence
  Synthetic oligonucleotide
aguaagcaagccagaaauucggaguua

SEQ ID NO: 13776 - RNA, 27 nt, Artificial Sequence
  Synthetic oligonucleotide
guaagcaagccagaaauucggaguuau

SEQ ID NO: 13777 - RNA, 27 nt, Artificial Sequence
  Synthetic oligonucleotide
uaagcaagccagaaauucggaguuauu

SEQ ID NO: 13778 - RNA, 27 nt, Artificial Sequence
  Synthetic oligonucleotide
aagcaagccagaaauucggaguuauuu

SEQ ID NO: 13779 - RNA, 27 nt, Artificial Sequence
  Synthetic oligonucleotide
gcaagccagaaauucggaguuauuuuc

SEQ ID NO: 13780 - RNA, 27 nt, Artificial Sequence
  Synthetic oligonucleotide
caagccagaaauucggaguuauuuucc

SEQ ID NO: 13781 - RNA, 27 nt, Artificial Sequence
  Synthetic oligonucleotide
aagccagaaauucggaguuauuuucca

SEQ ID NO: 13782 - RNA, 27 nt, Artificial Sequence
  Synthetic oligonucleotide
agccagaaauucggaguuauuuuccag

SEQ ID NO: 13783 - RNA, 27 nt, Artificial Sequence
  Synthetic oligonucleotide
gccagaaauucggaguuauuuuccaga

SEQ ID NO: 13784 - RNA, 27 nt, Artificial Sequence
  Synthetic oligonucleotide
ccagaaauucggaguuauuuuccagaa

SEQ ID NO: 13785 - RNA, 27 nt, Artificial Sequence
  Synthetic oligonucleotide
cagaaauucggaguuauuuuccagaaa

SEQ ID NO: 13786 - RNA, 27 nt, Artificial Sequence
  Synthetic oligonucleotide
agaaauucggaguuauuuuccagaaag

SEQ ID NO: 13787 - RNA, 27 nt, Artificial Sequence
  Synthetic oligonucleotide
gaaauucggaguuauuuuccagaaagc

SEQ ID NO: 13788 - RNA, 27 nt, Artificial Sequence
  Synthetic oligonucleotide
aaauucggaguuauuuuccagaaagcu

SEQ ID NO: 13789 - RNA, 27 nt, Artificial Sequence
  Synthetic oligonucleotide
aauucggaguuauuuuccagaaagcug

SEQ ID NO: 13790 - RNA, 27 nt, Artificial Sequence
  Synthetic oligonucleotide
auucggaguuauuuuccagaaagcugg

SEQ ID NO: 13791 - RNA, 27 nt, Artificial Sequence
  Synthetic oligonucleotide
uucggaguuauuuuccagaaagcuggu

SEQ ID NO: 13792 - RNA, 27 nt, Artificial Sequence
  Synthetic oligonucleotide
ucggaguuauuuuccagaaagcugguu

SEQ ID NO: 13793 - RNA, 27 nt, Artificial Sequence
  Synthetic oligonucleotide
cggaguuauuuuccagaaagcugguug

SEQ ID NO: 13794 - RNA, 27 nt, Artificial Sequence
  Synthetic oligonucleotide
ggaguuauuuuccagaaagcugguugu

SEQ ID NO: 13795 - RNA, 27 nt, Artificial Sequence
  Synthetic oligonucleotide
gaguuauuuuccagaaagcugguugug

SEQ ID NO: 13796 - RNA, 27 nt, Artificial Sequence
  Synthetic oligonucleotide
aguuauuuuccagaaagcugguugugg

SEQ ID NO: 13797 - RNA, 27 nt, Artificial Sequence
  Synthetic oligonucleotide
guuauuuuccagaaagcugguuguggg

SEQ ID NO: 13798 - RNA, 27 nt, Artificial Sequence
  Synthetic oligonucleotide
uuauuuuccagaaagcugguuguggga

SEQ ID NO: 13799 - RNA, 27 nt, Artificial Sequence
  Synthetic oligonucleotide
ugugggaaguucaucuuguucccagaa

SEQ ID NO: 13800 - RNA, 27 nt, Artificial Sequence
  Synthetic oligonucleotide
gugggaaguucaucuuguucccagaag

SEQ ID NO: 13801 - RNA, 27 nt, Artificial Sequence
  Synthetic oligonucleotide
ugggaaguucaucuuguucccagaaga

SEQ ID NO: 13802 - RNA, 27 nt, Artificial Sequence
  Synthetic oligonucleotide
gggaaguucaucuuguucccagaagaa

SEQ ID NO: 13803 - RNA, 27 nt, Artificial Sequence
  Synthetic oligonucleotide
ggaaguucaucuuguucccagaagaaa

SEQ ID NO: 13804 - RNA, 27 nt, Artificial Sequence
  Synthetic oligonucleotide
gaaguucaucuuguucccagaagaaaa

SEQ ID NO: 13805 - RNA, 27 nt, Artificial Sequence
  Synthetic oligonucleotide
aaguucaucuuguucccagaagaaaac

SEQ ID NO: 13806 - RNA, 27 nt, Artificial Sequence
  Synthetic oligonucleotide
aguucaucuuguucccagaagaaaaca

SEQ ID NO: 13807 - RNA, 27 nt, Artificial Sequence
  Synthetic oligonucleotide
guucaucuuguucccagaagaaaacag

SEQ ID NO: 13808 - RNA, 27 nt, Artificial Sequence
  Synthetic oligonucleotide
uucaucuuguucccagaagaaaacagu

SEQ ID NO: 13809 - RNA, 27 nt, Artificial Sequence
  Synthetic oligonucleotide
ucaucuuguucccagaagaaaacaguu

SEQ ID NO: 13810 - RNA, 27 nt, Artificial Sequence
  Synthetic oligonucleotide
caucuuguucccagaagaaaacaguug

SEQ ID NO: 13811 - RNA, 27 nt, Artificial Sequence
  Synthetic oligonucleotide
aucuuguucccagaagaaaacaguugc

SEQ ID NO: 13812 - RNA, 27 nt, Artificial Sequence
  Synthetic oligonucleotide
ucuuguucccagaagaaaacaguugca

SEQ ID NO: 13813 - RNA, 27 nt, Artificial Sequence
  Synthetic oligonucleotide
cuuguucccagaagaaaacaguugcag

SEQ ID NO: 13814 - RNA, 27 nt, Artificial Sequence
  Synthetic oligonucleotide
uuguucccagaagaaaacaguugcagu

SEQ ID NO: 13815 - RNA, 27 nt, Artificial Sequence
  Synthetic oligonucleotide
uguucccagaagaaaacaguugcaguu

SEQ ID NO: 13816 - RNA, 27 nt, Artificial Sequence
  Synthetic oligonucleotide
guucccagaagaaaacaguugcaguuu

SEQ ID NO: 13817 - RNA, 27 nt, Artificial Sequence
  Synthetic oligonucleotide
uucccagaagaaaacaguugcaguuug

SEQ ID NO: 13818 - RNA, 27 nt, Artificial Sequence
  Synthetic oligonucleotide
ucccagaagaaaacaguugcaguuugc

SEQ ID NO: 13819 - RNA, 27 nt, Artificial Sequence
  Synthetic oligonucleotide
cccagaagaaaacaguugcaguuugcc

SEQ ID NO: 13820 - RNA, 27 nt, Artificial Sequence
  Synthetic oligonucleotide
ccagaagaaaacaguugcaguuugccc

SEQ ID NO: 13821 - RNA, 27 nt, Artificial Sequence
  Synthetic oligonucleotide
cagaagaaaacaguugcaguuugcccu

SEQ ID NO: 13822 - RNA, 27 nt, Artificial Sequence
  Synthetic oligonucleotide
agaagaaaacaguugcaguuugcccua

SEQ ID NO: 13823 - RNA, 27 nt, Artificial Sequence
  Synthetic oligonucleotide
gaagaaaacaguugcaguuugcccuac

SEQ ID NO: 13824 - RNA, 27 nt, Artificial Sequence
  Synthetic oligonucleotide
aagaaaacaguugcaguuugcccuacc

SEQ ID NO: 13825 - RNA, 27 nt, Artificial Sequence
  Synthetic oligonucleotide
agaaaacaguugcaguuugcccuaccu

SEQ ID NO: 13826 - RNA, 27 nt, Artificial Sequence
  Synthetic oligonucleotide
gaaaacaguugcaguuugcccuaccug

SEQ ID NO: 13827 - RNA, 27 nt, Artificial Sequence
  Synthetic oligonucleotide
aaaacaguugcaguuugcccuaccuga

SEQ ID NO: 13828 - RNA, 27 nt, Artificial Sequence
  Synthetic oligonucleotide
aaacaguugcaguuugcccuaccugau

SEQ ID NO: 13829 - RNA, 27 nt, Artificial Sequence
  Synthetic oligonucleotide
aacaguugcaguuugcccuaccugauu

SEQ ID NO: 13830 - RNA, 27 nt, Artificial Sequence
  Synthetic oligonucleotide
acaguugcaguuugcccuaccugauuc

SEQ ID NO: 13831 - RNA, 27 nt, Artificial Sequence
  Synthetic oligonucleotide
caguugcaguuugcccuaccugauucu

SEQ ID NO: 13832 - RNA, 27 nt, Artificial Sequence
  Synthetic oligonucleotide
aguugcaguuugcccuaccugauucuc

SEQ ID NO: 13833 - RNA, 27 nt, Artificial Sequence
  Synthetic oligonucleotide
guugcaguuugcccuaccugauucucu

SEQ ID NO: 13834 - RNA, 27 nt, Artificial Sequence
  Synthetic oligonucleotide
uugcaguuugcccuaccugauucucua

SEQ ID NO: 13835 - RNA, 27 nt, Artificial Sequence
  Synthetic oligonucleotide
ugcaguuugcccuaccugauucucuaa

SEQ ID NO: 13836 - RNA, 27 nt, Artificial Sequence
  Synthetic oligonucleotide
gcaguuugcccuaccugauucucuaac

SEQ ID NO: 13837 - RNA, 27 nt, Artificial Sequence
  Synthetic oligonucleotide
caguuugcccuaccugauucucuaacc

SEQ ID NO: 13838 - RNA, 27 nt, Artificial Sequence
  Synthetic oligonucleotide
aaggcaaagguguucaaagaugucuuc

SEQ ID NO: 13839 - RNA, 27 nt, Artificial Sequence
  Synthetic oligonucleotide
aggcaaagguguucaaagaugucuucc

SEQ ID NO: 13840 - RNA, 27 nt, Artificial Sequence
  Synthetic oligonucleotide
ggcaaagguguucaaagaugucuuccu

SEQ ID NO: 13841 - RNA, 27 nt, Artificial Sequence
  Synthetic oligonucleotide
gcaaagguguucaaagaugucuuccug

SEQ ID NO: 13842 - RNA, 27 nt, Artificial Sequence
  Synthetic oligonucleotide
caaagguguucaaagaugucuuccugg

SEQ ID NO: 13843 - RNA, 27 nt, Artificial Sequence
  Synthetic oligonucleotide
aaagguguucaaagaugucuuccugga

SEQ ID NO: 13844 - RNA, 27 nt, Artificial Sequence
  Synthetic oligonucleotide
aagguguucaaagaugucuuccuggaa

SEQ ID NO: 13845 - RNA, 27 nt, Artificial Sequence
  Synthetic oligonucleotide
agguguucaaagaugucuuccuggaaa

SEQ ID NO: 13846 - RNA, 27 nt, Artificial Sequence
  Synthetic oligonucleotide
gguguucaaagaugucuuccuggaaau

SEQ ID NO: 13847 - RNA, 27 nt, Artificial Sequence
  Synthetic oligonucleotide
guguucaaagaugucuuccuggaaaug

SEQ ID NO: 13848 - RNA, 27 nt, Artificial Sequence
  Synthetic oligonucleotide
uguucaaagaugucuuccuggaaauga

SEQ ID NO: 13849 - RNA, 27 nt, Artificial Sequence
  Synthetic oligonucleotide
guucaaagaugucuuccuggaaaugaa

SEQ ID NO: 13850 - RNA, 27 nt, Artificial Sequence
  Synthetic oligonucleotide
uucaaagaugucuuccuggaaaugaau

SEQ ID NO: 13851 - RNA, 27 nt, Artificial Sequence
  Synthetic oligonucleotide
ucaaagaugucuuccuggaaaugaaua

SEQ ID NO: 13852 - RNA, 27 nt, Artificial Sequence
  Synthetic oligonucleotide
caaagaugucuuccuggaaaugaauau

SEQ ID NO: 13853 - RNA, 27 nt, Artificial Sequence
  Synthetic oligonucleotide
aaagaugucuuccuggaaaugaauaua

SEQ ID NO: 13854 - RNA, 27 nt, Artificial Sequence
  Synthetic oligonucleotide
agaugucuuccuggaaaugaauauacc

SEQ ID NO: 13855 - RNA, 27 nt, Artificial Sequence
  Synthetic oligonucleotide
gaugucuuccuggaaaugaauauacca

SEQ ID NO: 13856 - RNA, 27 nt, Artificial Sequence
  Synthetic oligonucleotide
augucuuccuggaaaugaauauaccau

SEQ ID NO: 13857 - RNA, 27 nt, Artificial Sequence
  Synthetic oligonucleotide
ugucuuccuggaaaugaauauaccaua

SEQ ID NO: 13858 - RNA, 27 nt, Artificial Sequence
  Synthetic oligonucleotide
gucuuccuggaaaugaauauaccauau

SEQ ID NO: 13859 - RNA, 27 nt, Artificial Sequence
  Synthetic oligonucleotide
ucuuccuggaaaugaauauaccauauu

SEQ ID NO: 13860 - RNA, 27 nt, Artificial Sequence
  Synthetic oligonucleotide
cuuccuggaaaugaauauaccauauuc

SEQ ID NO: 13861 - RNA, 27 nt, Artificial Sequence
  Synthetic oligonucleotide
uuccuggaaaugaauauaccauauucu

SEQ ID NO: 13862 - RNA, 27 nt, Artificial Sequence
  Synthetic oligonucleotide
aauauaccauauucuguuguacgagga

SEQ ID NO: 13863 - RNA, 27 nt, Artificial Sequence
  Synthetic oligonucleotide
auauaccauauucuguuguacgaggag

SEQ ID NO: 13864 - RNA, 27 nt, Artificial Sequence
  Synthetic oligonucleotide
uauaccauauucuguuguacgaggaga

SEQ ID NO: 13865 - RNA, 27 nt, Artificial Sequence
  Synthetic oligonucleotide
auaccauauucuguuguacgaggagaa

SEQ ID NO: 13866 - RNA, 27 nt, Artificial Sequence
  Synthetic oligonucleotide
uaccauauucuguuguacgaggagaac

SEQ ID NO: 13867 - RNA, 27 nt, Artificial Sequence
  Synthetic oligonucleotide
accauauucuguuguacgaggagaaca

SEQ ID NO: 13868 - RNA, 27 nt, Artificial Sequence
  Synthetic oligonucleotide
ccauauucuguuguacgaggagaacag

SEQ ID NO: 13869 - RNA, 27 nt, Artificial Sequence
  Synthetic oligonucleotide
cauauucuguuguacgaggagaacaga

SEQ ID NO: 13870 - RNA, 27 nt, Artificial Sequence
  Synthetic oligonucleotide
auauucuguuguacgaggagaacagau

SEQ ID NO: 13871 - RNA, 27 nt, Artificial Sequence
  Synthetic oligonucleotide
uauucuguuguacgaggagaacagauc

SEQ ID NO: 13872 - RNA, 27 nt, Artificial Sequence
  Synthetic oligonucleotide
auucuguuguacgaggagaacagaucc

SEQ ID NO: 13873 - RNA, 27 nt, Artificial Sequence
  Synthetic oligonucleotide
uucuguuguacgaggagaacagaucca

SEQ ID NO: 13874 - RNA, 27 nt, Artificial Sequence
  Synthetic oligonucleotide
ucuguuguacgaggagaacagauccaa

SEQ ID NO: 13875 - RNA, 27 nt, Artificial Sequence
  Synthetic oligonucleotide
aggaacuguuuacaacuauaggacuuc

SEQ ID NO: 13876 - RNA, 27 nt, Artificial Sequence
  Synthetic oligonucleotide
ggaacuguuuacaacuauaggacuucu

SEQ ID NO: 13877 - RNA, 27 nt, Artificial Sequence
  Synthetic oligonucleotide
gaacuguuuacaacuauaggacuucug

SEQ ID NO: 13878 - RNA, 27 nt, Artificial Sequence
  Synthetic oligonucleotide
aacuguuuacaacuauaggacuucugg

SEQ ID NO: 13879 - RNA, 27 nt, Artificial Sequence
  Synthetic oligonucleotide
acuguuuacaacuauaggacuucuggg

SEQ ID NO: 13880 - RNA, 27 nt, Artificial Sequence
  Synthetic oligonucleotide
cuguuuacaacuauaggacuucuggga

SEQ ID NO: 13881 - RNA, 27 nt, Artificial Sequence
  Synthetic oligonucleotide
uguuuacaacuauaggacuucugggau

SEQ ID NO: 13882 - RNA, 27 nt, Artificial Sequence
  Synthetic oligonucleotide
guuuacaacuauaggacuucugggaug

SEQ ID NO: 13883 - RNA, 27 nt, Artificial Sequence
  Synthetic oligonucleotide
uuuacaacuauaggacuucugggaugc

SEQ ID NO: 13884 - RNA, 27 nt, Artificial Sequence
  Synthetic oligonucleotide
uuacaacuauaggacuucugggaugca

SEQ ID NO: 13885 - RNA, 27 nt, Artificial Sequence
  Synthetic oligonucleotide
uacaacuauaggacuucugggaugcag

SEQ ID NO: 13886 - RNA, 27 nt, Artificial Sequence
  Synthetic oligonucleotide
acaacuauaggacuucugggaugcagu

SEQ ID NO: 13887 - RNA, 27 nt, Artificial Sequence
  Synthetic oligonucleotide
caacuauaggacuucugggaugcaguu

SEQ ID NO: 13888 - RNA, 27 nt, Artificial Sequence
  Synthetic oligonucleotide
aacuauaggacuucugggaugcaguuc

SEQ ID NO: 13889 - RNA, 27 nt, Artificial Sequence
  Synthetic oligonucleotide
acuauaggacuucugggaugcaguucu

SEQ ID NO: 13890 - RNA, 27 nt, Artificial Sequence
  Synthetic oligonucleotide
cuauaggacuucugggaugcaguucug

SEQ ID NO: 13891 - RNA, 27 nt, Artificial Sequence
  Synthetic oligonucleotide
uauaggacuucugggaugcaguucugu

SEQ ID NO: 13892 - RNA, 27 nt, Artificial Sequence
  Synthetic oligonucleotide
auaggacuucugggaugcaguucugug

SEQ ID NO: 13893 - RNA, 27 nt, Artificial Sequence
  Synthetic oligonucleotide
aaaaugucugcuguggagggaaucugc

SEQ ID NO: 13894 - RNA, 27 nt, Artificial Sequence
  Synthetic oligonucleotide
aaaugucugcuguggagggaaucugca

SEQ ID NO: 13895 - RNA, 27 nt, Artificial Sequence
  Synthetic oligonucleotide
aaugucugcuguggagggaaucugcac

SEQ ID NO: 13896 - RNA, 27 nt, Artificial Sequence
  Synthetic oligonucleotide
augucugcuguggagggaaucugcacu

SEQ ID NO: 13897 - RNA, 27 nt, Artificial Sequence
  Synthetic oligonucleotide
ugucugcuguggagggaaucugcacuu

SEQ ID NO: 13898 - RNA, 27 nt, Artificial Sequence
  Synthetic oligonucleotide
gucugcuguggagggaaucugcacuuc

SEQ ID NO: 13899 - RNA, 27 nt, Artificial Sequence
  Synthetic oligonucleotide
ucugcuguggagggaaucugcacuucg

SEQ ID NO: 13900 - RNA, 27 nt, Artificial Sequence
  Synthetic oligonucleotide
cugcuguggagggaaucugcacuucgg

SEQ ID NO: 13901 - RNA, 27 nt, Artificial Sequence
  Synthetic oligonucleotide
ugcuguggagggaaucugcacuucgga

SEQ ID NO: 13902 - RNA, 27 nt, Artificial Sequence
  Synthetic oligonucleotide
gcuguggagggaaucugcacuucggaa

SEQ ID NO: 13903 - RNA, 27 nt, Artificial Sequence
  Synthetic oligonucleotide
cuguggagggaaucugcacuucggaaa

SEQ ID NO: 13904 - RNA, 27 nt, Artificial Sequence
  Synthetic oligonucleotide
uguggagggaaucugcacuucggaaag

SEQ ID NO: 13905 - RNA, 27 nt, Artificial Sequence
  Synthetic oligonucleotide
cggaaagcccagucauugaucaucagg

SEQ ID NO: 13906 - RNA, 27 nt, Artificial Sequence
  Synthetic oligonucleotide
ggaaagcccagucauugaucaucaggg

SEQ ID NO: 13907 - RNA, 27 nt, Artificial Sequence
  Synthetic oligonucleotide
gaaagcccagucauugaucaucagggc

SEQ ID NO: 13908 - RNA, 27 nt, Artificial Sequence
  Synthetic oligonucleotide
aaagcccagucauugaucaucagggca

SEQ ID NO: 13909 - RNA, 27 nt, Artificial Sequence
  Synthetic oligonucleotide
aagcccagucauugaucaucagggcac

SEQ ID NO: 13910 - RNA, 27 nt, Artificial Sequence
  Synthetic oligonucleotide
agcccagucauugaucaucagggcaca

SEQ ID NO: 13911 - RNA, 27 nt, Artificial Sequence
  Synthetic oligonucleotide
gcccagucauugaucaucagggcacaa

SEQ ID NO: 13912 - RNA, 27 nt, Artificial Sequence
  Synthetic oligonucleotide
cccagucauugaucaucagggcacaaa

SEQ ID NO: 13913 - RNA, 27 nt, Artificial Sequence
  Synthetic oligonucleotide
ccagucauugaucaucagggcacaaag

SEQ ID NO: 13914 - RNA, 27 nt, Artificial Sequence
  Synthetic oligonucleotide
cagucauugaucaucagggcacaaagu

SEQ ID NO: 13915 - RNA, 27 nt, Artificial Sequence
  Synthetic oligonucleotide
agucauugaucaucagggcacaaaguc

SEQ ID NO: 13916 - RNA, 27 nt, Artificial Sequence
  Synthetic oligonucleotide
gucauugaucaucagggcacaaagucc

SEQ ID NO: 13917 - RNA, 27 nt, Artificial Sequence
  Synthetic oligonucleotide
ucauugaucaucagggcacaaaguccu

SEQ ID NO: 13918 - RNA, 27 nt, Artificial Sequence
  Synthetic oligonucleotide
cauugaucaucagggcacaaaguccuc

SEQ ID NO: 13919 - RNA, 27 nt, Artificial Sequence
  Synthetic oligonucleotide
auugaucaucagggcacaaaguccucc

SEQ ID NO: 13920 - RNA, 27 nt, Artificial Sequence
  Synthetic oligonucleotide
uugaucaucagggcacaaaguccucca

SEQ ID NO: 13921 - RNA, 27 nt, Artificial Sequence
  Synthetic oligonucleotide
ugaucaucagggcacaaaguccuccaa

SEQ ID NO: 13922 - RNA, 27 nt, Artificial Sequence
  Synthetic oligonucleotide
gaucaucagggcacaaaguccuccaaa

SEQ ID NO: 13923 - RNA, 27 nt, Artificial Sequence
  Synthetic oligonucleotide
aucaucagggcacaaaguccuccaaau

SEQ ID NO: 13924 - RNA, 27 nt, Artificial Sequence
  Synthetic oligonucleotide
ucaucagggcacaaaguccuccaaaug

SEQ ID NO: 13925 - RNA, 27 nt, Artificial Sequence
  Synthetic oligonucleotide
caucagggcacaaaguccuccaaaugu

SEQ ID NO: 13926 - RNA, 27 nt, Artificial Sequence
  Synthetic oligonucleotide
aucagggcacaaaguccuccaaaugug

SEQ ID NO: 13927 - RNA, 27 nt, Artificial Sequence
  Synthetic oligonucleotide
ccagaaaguagagggcuccuccaguca

SEQ ID NO: 13928 - RNA, 27 nt, Artificial Sequence
  Synthetic oligonucleotide
ucacugugcuuccucuggaaauuggcc

SEQ ID NO: 13929 - RNA, 27 nt, Artificial Sequence
  Synthetic oligonucleotide
cacugugcuuccucuggaaauuggccu

SEQ ID NO: 13930 - RNA, 27 nt, Artificial Sequence
  Synthetic oligonucleotide
acugugcuuccucuggaaauuggccuu

SEQ ID NO: 13931 - RNA, 27 nt, Artificial Sequence
  Synthetic oligonucleotide
cugugcuuccucuggaaauuggccuuc

SEQ ID NO: 13932 - RNA, 27 nt, Artificial Sequence
  Synthetic oligonucleotide
ugguuuggaaaagaaaucuuaguaaaa

SEQ ID NO: 13933 - RNA, 27 nt, Artificial Sequence
  Synthetic oligonucleotide
gguuuggaaaagaaaucuuaguaaaaa

SEQ ID NO: 13934 - RNA, 27 nt, Artificial Sequence
  Synthetic oligonucleotide
guuuggaaaagaaaucuuaguaaaaac

SEQ ID NO: 13935 - RNA, 27 nt, Artificial Sequence
  Synthetic oligonucleotide
uuuggaaaagaaaucuuaguaaaaaca

SEQ ID NO: 13936 - RNA, 27 nt, Artificial Sequence
  Synthetic oligonucleotide
uuggaaaagaaaucuuaguaaaaacau

SEQ ID NO: 13937 - RNA, 27 nt, Artificial Sequence
  Synthetic oligonucleotide
uggaaaagaaaucuuaguaaaaacauu

SEQ ID NO: 13938 - RNA, 27 nt, Artificial Sequence
  Synthetic oligonucleotide
ggaaaagaaaucuuaguaaaaacauua

SEQ ID NO: 13939 - RNA, 27 nt, Artificial Sequence
  Synthetic oligonucleotide
cauuacgaguggugccagaagguguca

SEQ ID NO: 13940 - RNA, 27 nt, Artificial Sequence
  Synthetic oligonucleotide
auuacgaguggugccagaaggugucaa

SEQ ID NO: 13941 - RNA, 27 nt, Artificial Sequence
  Synthetic oligonucleotide
uuacgaguggugccagaaggugucaaa

SEQ ID NO: 13942 - RNA, 27 nt, Artificial Sequence
  Synthetic oligonucleotide
uacgaguggugccagaaggugucaaaa

SEQ ID NO: 13943 - RNA, 27 nt, Artificial Sequence
  Synthetic oligonucleotide
acgaguggugccagaaggugucaaaag

SEQ ID NO: 13944 - RNA, 27 nt, Artificial Sequence
  Synthetic oligonucleotide
cgaguggugccagaaggugucaaaagg

SEQ ID NO: 13945 - RNA, 27 nt, Artificial Sequence
  Synthetic oligonucleotide
gaguggugccagaaggugucaaaaggg

SEQ ID NO: 13946 - RNA, 27 nt, Artificial Sequence
  Synthetic oligonucleotide
aguggugccagaaggugucaaaaggga

SEQ ID NO: 13947 - RNA, 27 nt, Artificial Sequence
  Synthetic oligonucleotide
guggugccagaaggugucaaaagggaa

SEQ ID NO: 13948 - RNA, 27 nt, Artificial Sequence
  Synthetic oligonucleotide
uggugccagaaggugucaaaagggaaa

SEQ ID NO: 13949 - RNA, 27 nt, Artificial Sequence
  Synthetic oligonucleotide
ggugccagaaggugucaaaagggaaag

SEQ ID NO: 13950 - RNA, 27 nt, Artificial Sequence
  Synthetic oligonucleotide
gugccagaaggugucaaaagggaaagc

SEQ ID NO: 13951 - RNA, 27 nt, Artificial Sequence
  Synthetic oligonucleotide
ugccagaaggugucaaaagggaaagcu

SEQ ID NO: 13952 - RNA, 27 nt, Artificial Sequence
  Synthetic oligonucleotide
gccagaaggugucaaaagggaaagcua

SEQ ID NO: 13953 - RNA, 27 nt, Artificial Sequence
  Synthetic oligonucleotide
ccagaaggugucaaaagggaaagcuau

SEQ ID NO: 13954 - RNA, 27 nt, Artificial Sequence
  Synthetic oligonucleotide
cagaaggugucaaaagggaaagcuauu

SEQ ID NO: 13955 - RNA, 27 nt, Artificial Sequence
  Synthetic oligonucleotide
agaaggugucaaaagggaaagcuauuc

SEQ ID NO: 13956 - RNA, 27 nt, Artificial Sequence
  Synthetic oligonucleotide
gaaggugucaaaagggaaagcuauucu

SEQ ID NO: 13957 - RNA, 27 nt, Artificial Sequence
  Synthetic oligonucleotide
aaggugucaaaagggaaagcuauucug

SEQ ID NO: 13958 - RNA, 27 nt, Artificial Sequence
  Synthetic oligonucleotide
aggugucaaaagggaaagcuauucugg

SEQ ID NO: 13959 - RNA, 27 nt, Artificial Sequence
  Synthetic oligonucleotide
ggugucaaaagggaaagcuauucuggu

SEQ ID NO: 13960 - RNA, 27 nt, Artificial Sequence
  Synthetic oligonucleotide
gugucaaaagggaaagcuauucuggug

SEQ ID NO: 13961 - RNA, 27 nt, Artificial Sequence
  Synthetic oligonucleotide
ugucaaaagggaaagcuauucuggugu

SEQ ID NO: 13962 - RNA, 27 nt, Artificial Sequence
  Synthetic oligonucleotide
gucaaaagggaaagcuauucugguguu

SEQ ID NO: 13963 - RNA, 27 nt, Artificial Sequence
  Synthetic oligonucleotide
ucaaaagggaaagcuauucugguguua

SEQ ID NO: 13964 - RNA, 27 nt, Artificial Sequence
  Synthetic oligonucleotide
caaaagggaaagcuauucugguguuac

SEQ ID NO: 13965 - RNA, 27 nt, Artificial Sequence
  Synthetic oligonucleotide
aaaagggaaagcuauucugguguuacu

SEQ ID NO: 13966 - RNA, 27 nt, Artificial Sequence
  Synthetic oligonucleotide
uguuacuuuggauccuagggguauuua

SEQ ID NO: 13967 - RNA, 27 nt, Artificial Sequence
  Synthetic oligonucleotide
guuacuuuggauccuagggguauuuau

SEQ ID NO: 13968 - RNA, 27 nt, Artificial Sequence
  Synthetic oligonucleotide
uuacuuuggauccuagggguauuuaug

SEQ ID NO: 13969 - RNA, 27 nt, Artificial Sequence
  Synthetic oligonucleotide
uacuuuggauccuagggguauuuaugg

SEQ ID NO: 13970 - RNA, 27 nt, Artificial Sequence
  Synthetic oligonucleotide
acuuuggauccuagggguauuuauggu

SEQ ID NO: 13971 - RNA, 27 nt, Artificial Sequence
  Synthetic oligonucleotide
cuuuggauccuagggguauuuauggua

SEQ ID NO: 13972 - RNA, 27 nt, Artificial Sequence
  Synthetic oligonucleotide
uuuggauccuagggguauuuaugguac

SEQ ID NO: 13973 - RNA, 27 nt, Artificial Sequence
  Synthetic oligonucleotide
uuggauccuagggguauuuaugguacc

SEQ ID NO: 13974 - RNA, 27 nt, Artificial Sequence
  Synthetic oligonucleotide
uggauccuagggguauuuaugguacca

SEQ ID NO: 13975 - RNA, 27 nt, Artificial Sequence
  Synthetic oligonucleotide
gacgaaaggaguucccauacaggauac

SEQ ID NO: 13976 - RNA, 27 nt, Artificial Sequence
  Synthetic oligonucleotide
acgaaaggaguucccauacaggauacc

SEQ ID NO: 13977 - RNA, 27 nt, Artificial Sequence
  Synthetic oligonucleotide
cgaaaggaguucccauacaggauaccc

SEQ ID NO: 13978 - RNA, 27 nt, Artificial Sequence
  Synthetic oligonucleotide
gaaaggaguucccauacaggauacccu

SEQ ID NO: 13979 - RNA, 27 nt, Artificial Sequence
  Synthetic oligonucleotide
aaaggaguucccauacaggauacccuu

SEQ ID NO: 13980 - RNA, 27 nt, Artificial Sequence
  Synthetic oligonucleotide
aaggaguucccauacaggauacccuua

SEQ ID NO: 13981 - RNA, 27 nt, Artificial Sequence
  Synthetic oligonucleotide
aggaguucccauacaggauacccuuag

SEQ ID NO: 13982 - RNA, 27 nt, Artificial Sequence
  Synthetic oligonucleotide
ggaguucccauacaggauacccuuaga

SEQ ID NO: 13983 - RNA, 27 nt, Artificial Sequence
  Synthetic oligonucleotide
ccuuagauuugguccccaaaacagaaa

SEQ ID NO: 13984 - RNA, 27 nt, Artificial Sequence
  Synthetic oligonucleotide
cuuagauuugguccccaaaacagaaau

SEQ ID NO: 13985 - RNA, 27 nt, Artificial Sequence
  Synthetic oligonucleotide
uuagauuugguccccaaaacagaaauc

SEQ ID NO: 13986 - RNA, 27 nt, Artificial Sequence
  Synthetic oligonucleotide
uagauuugguccccaaaacagaaauca

SEQ ID NO: 13987 - RNA, 27 nt, Artificial Sequence
  Synthetic oligonucleotide
agauuugguccccaaaacagaaaucaa

SEQ ID NO: 13988 - RNA, 27 nt, Artificial Sequence
  Synthetic oligonucleotide
gauuugguccccaaaacagaaaucaaa

SEQ ID NO: 13989 - RNA, 27 nt, Artificial Sequence
  Synthetic oligonucleotide
auuugguccccaaaacagaaaucaaaa

SEQ ID NO: 13990 - RNA, 27 nt, Artificial Sequence
  Synthetic oligonucleotide
uuugguccccaaaacagaaaucaaaag

SEQ ID NO: 13991 - RNA, 27 nt, Artificial Sequence
  Synthetic oligonucleotide
uugguccccaaaacagaaaucaaaagg

SEQ ID NO: 13992 - RNA, 27 nt, Artificial Sequence
  Synthetic oligonucleotide
ugguccccaaaacagaaaucaaaagga

SEQ ID NO: 13993 - RNA, 27 nt, Artificial Sequence
  Synthetic oligonucleotide
gguccccaaaacagaaaucaaaaggau

SEQ ID NO: 13994 - RNA, 27 nt, Artificial Sequence
  Synthetic oligonucleotide
guccccaaaacagaaaucaaaaggauu

SEQ ID NO: 13995 - RNA, 27 nt, Artificial Sequence
  Synthetic oligonucleotide
uccccaaaacagaaaucaaaaggauuu

SEQ ID NO: 13996 - RNA, 27 nt, Artificial Sequence
  Synthetic oligonucleotide
ccccaaaacagaaaucaaaaggauuuu

SEQ ID NO: 13997 - RNA, 27 nt, Artificial Sequence
  Synthetic oligonucleotide
cccaaaacagaaaucaaaaggauuuug

SEQ ID NO: 13998 - RNA, 27 nt, Artificial Sequence
  Synthetic oligonucleotide
ccaaaacagaaaucaaaaggauuuuga

SEQ ID NO: 13999 - RNA, 27 nt, Artificial Sequence
  Synthetic oligonucleotide
caaaacagaaaucaaaaggauuuugag

SEQ ID NO: 14000 - RNA, 27 nt, Artificial Sequence
  Synthetic oligonucleotide
aaaacagaaaucaaaaggauuuugagu

SEQ ID NO: 14001 - RNA, 27 nt, Artificial Sequence
  Synthetic oligonucleotide
aaacagaaaucaaaaggauuuugagug

SEQ ID NO: 14002 - RNA, 27 nt, Artificial Sequence
  Synthetic oligonucleotide
aacagaaaucaaaaggauuuugagugu

SEQ ID NO: 14003 - RNA, 27 nt, Artificial Sequence
  Synthetic oligonucleotide
agaaaucaaaaggauuuugaguguaaa

SEQ ID NO: 14004 - RNA, 27 nt, Artificial Sequence
  Synthetic oligonucleotide
gaaaucaaaaggauuuugaguguaaaa

SEQ ID NO: 14005 - RNA, 27 nt, Artificial Sequence
  Synthetic oligonucleotide
aaaucaaaaggauuuugaguguaaaag

SEQ ID NO: 14006 - RNA, 27 nt, Artificial Sequence
  Synthetic oligonucleotide
aaucaaaaggauuuugaguguaaaagg

SEQ ID NO: 14007 - RNA, 27 nt, Artificial Sequence
  Synthetic oligonucleotide
ucaaaaggauuuugaguguaaaaggac

SEQ ID NO: 14008 - RNA, 27 nt, Artificial Sequence
  Synthetic oligonucleotide
caaaaggauuuugaguguaaaaggacu

SEQ ID NO: 14009 - RNA, 27 nt, Artificial Sequence
  Synthetic oligonucleotide
aaaaggauuuugaguguaaaaggacug

SEQ ID NO: 14010 - RNA, 27 nt, Artificial Sequence
  Synthetic oligonucleotide
aaaggauuuugaguguaaaaggacugc

SEQ ID NO: 14011 - RNA, 27 nt, Artificial Sequence
  Synthetic oligonucleotide
aaggauuuugaguguaaaaggacugcu

SEQ ID NO: 14012 - RNA, 27 nt, Artificial Sequence
  Synthetic oligonucleotide
aggauuuugaguguaaaaggacugcuu

SEQ ID NO: 14013 - RNA, 27 nt, Artificial Sequence
  Synthetic oligonucleotide
ggauuuugaguguaaaaggacugcuug

SEQ ID NO: 14014 - RNA, 27 nt, Artificial Sequence
  Synthetic oligonucleotide
gauuuugaguguaaaaggacugcuugu

SEQ ID NO: 14015 - RNA, 27 nt, Artificial Sequence
  Synthetic oligonucleotide
auuuugaguguaaaaggacugcuugua

SEQ ID NO: 14016 - RNA, 27 nt, Artificial Sequence
  Synthetic oligonucleotide
uuuugaguguaaaaggacugcuuguag

SEQ ID NO: 14017 - RNA, 27 nt, Artificial Sequence
  Synthetic oligonucleotide
uuugaguguaaaaggacugcuuguagg

SEQ ID NO: 14018 - RNA, 27 nt, Artificial Sequence
  Synthetic oligonucleotide
uugaguguaaaaggacugcuuguaggu

SEQ ID NO: 14019 - RNA, 27 nt, Artificial Sequence
  Synthetic oligonucleotide
ugaguguaaaaggacugcuuguaggug

SEQ ID NO: 14020 - RNA, 27 nt, Artificial Sequence
  Synthetic oligonucleotide
gaguguaaaaggacugcuuguagguga

SEQ ID NO: 14021 - RNA, 27 nt, Artificial Sequence
  Synthetic oligonucleotide
aguguaaaaggacugcuuguaggugag

SEQ ID NO: 14022 - RNA, 27 nt, Artificial Sequence
  Synthetic oligonucleotide
guguaaaaggacugcuuguaggugaga

SEQ ID NO: 14023 - RNA, 27 nt, Artificial Sequence
  Synthetic oligonucleotide
uguaaaaggacugcuuguaggugagau

SEQ ID NO: 14024 - RNA, 27 nt, Artificial Sequence
  Synthetic oligonucleotide
guaaaaggacugcuuguaggugagauc

SEQ ID NO: 14025 - RNA, 27 nt, Artificial Sequence
  Synthetic oligonucleotide
uaaaaggacugcuuguaggugagaucu

SEQ ID NO: 14026 - RNA, 27 nt, Artificial Sequence
  Synthetic oligonucleotide
aaaaggacugcuuguaggugagaucuu

SEQ ID NO: 14027 - RNA, 27 nt, Artificial Sequence
  Synthetic oligonucleotide
aaaggacugcuuguaggugagaucuug

SEQ ID NO: 14028 - RNA, 27 nt, Artificial Sequence
  Synthetic oligonucleotide
aaggacugcuuguaggugagaucuugu

SEQ ID NO: 14029 - RNA, 27 nt, Artificial Sequence
  Synthetic oligonucleotide
aggacugcuuguaggugagaucuuguc

SEQ ID NO: 14030 - RNA, 27 nt, Artificial Sequence
  Synthetic oligonucleotide
ggacugcuuguaggugagaucuugucu

SEQ ID NO: 14031 - RNA, 27 nt, Artificial Sequence
  Synthetic oligonucleotide
gacugcuuguaggugagaucuugucug

SEQ ID NO: 14032 - RNA, 27 nt, Artificial Sequence
  Synthetic oligonucleotide
acugcuuguaggugagaucuugucugc

SEQ ID NO: 14033 - RNA, 27 nt, Artificial Sequence
  Synthetic oligonucleotide
cugcuuguaggugagaucuugucugca

SEQ ID NO: 14034 - RNA, 27 nt, Artificial Sequence
  Synthetic oligonucleotide
ugcuuguaggugagaucuugucugcag

SEQ ID NO: 14035 - RNA, 27 nt, Artificial Sequence
  Synthetic oligonucleotide
gcuuguaggugagaucuugucugcagu

SEQ ID NO: 14036 - RNA, 27 nt, Artificial Sequence
  Synthetic oligonucleotide
cuuguaggugagaucuugucugcaguu

SEQ ID NO: 14037 - RNA, 27 nt, Artificial Sequence
  Synthetic oligonucleotide
uuguaggugagaucuugucugcaguuc

SEQ ID NO: 14038 - RNA, 27 nt, Artificial Sequence
  Synthetic oligonucleotide
uguaggugagaucuugucugcaguucu

SEQ ID NO: 14039 - RNA, 27 nt, Artificial Sequence
  Synthetic oligonucleotide
guaggugagaucuugucugcaguucua

SEQ ID NO: 14040 - RNA, 27 nt, Artificial Sequence
  Synthetic oligonucleotide
uaggugagaucuugucugcaguucuaa

SEQ ID NO: 14041 - RNA, 27 nt, Artificial Sequence
  Synthetic oligonucleotide
aggugagaucuugucugcaguucuaag

SEQ ID NO: 14042 - RNA, 27 nt, Artificial Sequence
  Synthetic oligonucleotide
ggugagaucuugucugcaguucuaagu

SEQ ID NO: 14043 - RNA, 27 nt, Artificial Sequence
  Synthetic oligonucleotide
gugagaucuugucugcaguucuaaguc

SEQ ID NO: 14044 - RNA, 27 nt, Artificial Sequence
  Synthetic oligonucleotide
ugagaucuugucugcaguucuaaguca

SEQ ID NO: 14045 - RNA, 27 nt, Artificial Sequence
  Synthetic oligonucleotide
gagaucuugucugcaguucuaagucag

SEQ ID NO: 14046 - RNA, 27 nt, Artificial Sequence
  Synthetic oligonucleotide
agaucuugucugcaguucuaagucagg

SEQ ID NO: 14047 - RNA, 27 nt, Artificial Sequence
  Synthetic oligonucleotide
gaucuugucugcaguucuaagucagga

SEQ ID NO: 14048 - RNA, 27 nt, Artificial Sequence
  Synthetic oligonucleotide
aucuugucugcaguucuaagucaggaa

SEQ ID NO: 14049 - RNA, 27 nt, Artificial Sequence
  Synthetic oligonucleotide
ucuugucugcaguucuaagucaggaag

SEQ ID NO: 14050 - RNA, 27 nt, Artificial Sequence
  Synthetic oligonucleotide
caggaaggcaucaauauccuaacccac

SEQ ID NO: 14051 - RNA, 27 nt, Artificial Sequence
  Synthetic oligonucleotide
aggaaggcaucaauauccuaacccacc

SEQ ID NO: 14052 - RNA, 27 nt, Artificial Sequence
  Synthetic oligonucleotide
ggaaggcaucaauauccuaacccaccu

SEQ ID NO: 14053 - RNA, 27 nt, Artificial Sequence
  Synthetic oligonucleotide
gaaggcaucaauauccuaacccaccuc

SEQ ID NO: 14054 - RNA, 27 nt, Artificial Sequence
  Synthetic oligonucleotide
aaggcaucaauauccuaacccaccucc

SEQ ID NO: 14055 - RNA, 27 nt, Artificial Sequence
  Synthetic oligonucleotide
aggcaucaauauccuaacccaccuccc

SEQ ID NO: 14056 - RNA, 27 nt, Artificial Sequence
  Synthetic oligonucleotide
ggcaucaauauccuaacccaccucccc

SEQ ID NO: 14057 - RNA, 27 nt, Artificial Sequence
  Synthetic oligonucleotide
gcaucaauauccuaacccaccucccca

SEQ ID NO: 14058 - RNA, 27 nt, Artificial Sequence
  Synthetic oligonucleotide
caucaauauccuaacccaccuccccaa

SEQ ID NO: 14059 - RNA, 27 nt, Artificial Sequence
  Synthetic oligonucleotide
aucaauauccuaacccaccuccccaaa

SEQ ID NO: 14060 - RNA, 27 nt, Artificial Sequence
  Synthetic oligonucleotide
ucaauauccuaacccaccuccccaaag

SEQ ID NO: 14061 - RNA, 27 nt, Artificial Sequence
  Synthetic oligonucleotide
caauauccuaacccaccuccccaaagg

SEQ ID NO: 14062 - RNA, 27 nt, Artificial Sequence
  Synthetic oligonucleotide
aauauccuaacccaccuccccaaaggg

SEQ ID NO: 14063 - RNA, 27 nt, Artificial Sequence
  Synthetic oligonucleotide
cuaacccaccuccccaaagggagugca

SEQ ID NO: 14064 - RNA, 27 nt, Artificial Sequence
  Synthetic oligonucleotide
uaacccaccuccccaaagggagugcag

SEQ ID NO: 14065 - RNA, 27 nt, Artificial Sequence
  Synthetic oligonucleotide
aacccaccuccccaaagggagugcaga

SEQ ID NO: 14066 - RNA, 27 nt, Artificial Sequence
  Synthetic oligonucleotide
cagaggcggagcugaugagcguugucc

SEQ ID NO: 14067 - RNA, 27 nt, Artificial Sequence
  Synthetic oligonucleotide
aggcggagcugaugagcguugucccag

SEQ ID NO: 14068 - RNA, 27 nt, Artificial Sequence
  Synthetic oligonucleotide
ggcggagcugaugagcguugucccagu

SEQ ID NO: 14069 - RNA, 27 nt, Artificial Sequence
  Synthetic oligonucleotide
gcggagcugaugagcguugucccagua

SEQ ID NO: 14070 - RNA, 27 nt, Artificial Sequence
  Synthetic oligonucleotide
cggagcugaugagcguugucccaguau

SEQ ID NO: 14071 - RNA, 27 nt, Artificial Sequence
  Synthetic oligonucleotide
ggagcugaugagcguugucccaguauu

SEQ ID NO: 14072 - RNA, 27 nt, Artificial Sequence
  Synthetic oligonucleotide
gagcugaugagcguugucccaguauuc

SEQ ID NO: 14073 - RNA, 27 nt, Artificial Sequence
  Synthetic oligonucleotide
agcugaugagcguugucccaguauucu

SEQ ID NO: 14074 - RNA, 27 nt, Artificial Sequence
  Synthetic oligonucleotide
gcugaugagcguugucccaguauucua

SEQ ID NO: 14075 - RNA, 27 nt, Artificial Sequence
  Synthetic oligonucleotide
cugaugagcguugucccaguauucuau

SEQ ID NO: 14076 - RNA, 27 nt, Artificial Sequence
  Synthetic oligonucleotide
ugaugagcguugucccaguauucuaug

SEQ ID NO: 14077 - RNA, 27 nt, Artificial Sequence
  Synthetic oligonucleotide
gaugagcguugucccaguauucuaugu

SEQ ID NO: 14078 - RNA, 27 nt, Artificial Sequence
  Synthetic oligonucleotide
augagcguugucccaguauucuauguu

SEQ ID NO: 14079 - RNA, 27 nt, Artificial Sequence
  Synthetic oligonucleotide
ugagcguugucccaguauucuauguuu

SEQ ID NO: 14080 - RNA, 27 nt, Artificial Sequence
  Synthetic oligonucleotide
gagcguugucccaguauucuauguuuu

SEQ ID NO: 14081 - RNA, 27 nt, Artificial Sequence
  Synthetic oligonucleotide
agcguugucccaguauucuauguuuuu

SEQ ID NO: 14082 - RNA, 27 nt, Artificial Sequence
  Synthetic oligonucleotide
gcguugucccaguauucuauguuuuuc

SEQ ID NO: 14083 - RNA, 27 nt, Artificial Sequence
  Synthetic oligonucleotide
cguugucccaguauucuauguuuuuca

SEQ ID NO: 14084 - RNA, 27 nt, Artificial Sequence
  Synthetic oligonucleotide
guugucccaguauucuauguuuuucac

SEQ ID NO: 14085 - RNA, 27 nt, Artificial Sequence
  Synthetic oligonucleotide
uugucccaguauucuauguuuuucacu

SEQ ID NO: 14086 - RNA, 27 nt, Artificial Sequence
  Synthetic oligonucleotide
ugucccaguauucuauguuuuucacua

SEQ ID NO: 14087 - RNA, 27 nt, Artificial Sequence
  Synthetic oligonucleotide
gucccaguauucuauguuuuucacuac

SEQ ID NO: 14088 - RNA, 27 nt, Artificial Sequence
  Synthetic oligonucleotide
cccaguauucuauguuuuucacuaccu

SEQ ID NO: 14089 - RNA, 27 nt, Artificial Sequence
  Synthetic oligonucleotide
ccaguauucuauguuuuucacuaccug

SEQ ID NO: 14090 - RNA, 27 nt, Artificial Sequence
  Synthetic oligonucleotide
caguauucuauguuuuucacuaccugg

SEQ ID NO: 14091 - RNA, 27 nt, Artificial Sequence
  Synthetic oligonucleotide
aguauucuauguuuuucacuaccugga

SEQ ID NO: 14092 - RNA, 27 nt, Artificial Sequence
  Synthetic oligonucleotide
guauucuauguuuuucacuaccuggaa

SEQ ID NO: 14093 - RNA, 27 nt, Artificial Sequence
  Synthetic oligonucleotide
uauucuauguuuuucacuaccuggaaa

SEQ ID NO: 14094 - RNA, 27 nt, Artificial Sequence
  Synthetic oligonucleotide
auucuauguuuuucacuaccuggaaac

SEQ ID NO: 14095 - RNA, 27 nt, Artificial Sequence
  Synthetic oligonucleotide
uucuauguuuuucacuaccuggaaaca

SEQ ID NO: 14096 - RNA, 27 nt, Artificial Sequence
  Synthetic oligonucleotide
ucuauguuuuucacuaccuggaaacag

SEQ ID NO: 14097 - RNA, 27 nt, Artificial Sequence
  Synthetic oligonucleotide
cuauguuuuucacuaccuggaaacagg

SEQ ID NO: 14098 - RNA, 27 nt, Artificial Sequence
  Synthetic oligonucleotide
uauguuuuucacuaccuggaaacagga

SEQ ID NO: 14099 - RNA, 27 nt, Artificial Sequence
  Synthetic oligonucleotide
auguuuuucacuaccuggaaacaggaa

SEQ ID NO: 14100 - RNA, 27 nt, Artificial Sequence
  Synthetic oligonucleotide
uguuuuucacuaccuggaaacaggaaa

SEQ ID NO: 14101 - RNA, 27 nt, Artificial Sequence
  Synthetic oligonucleotide
guuuuucacuaccuggaaacaggaaau

SEQ ID NO: 14102 - RNA, 27 nt, Artificial Sequence
  Synthetic oligonucleotide
uuuuucacuaccuggaaacaggaaauc

SEQ ID NO: 14103 - RNA, 27 nt, Artificial Sequence
  Synthetic oligonucleotide
uuuucacuaccuggaaacaggaaauca

SEQ ID NO: 14104 - RNA, 27 nt, Artificial Sequence
  Synthetic oligonucleotide
uuucacuaccuggaaacaggaaaucau

SEQ ID NO: 14105 - RNA, 27 nt, Artificial Sequence
  Synthetic oligonucleotide
uucacuaccuggaaacaggaaaucauu

SEQ ID NO: 14106 - RNA, 27 nt, Artificial Sequence
  Synthetic oligonucleotide
ucacuaccuggaaacaggaaaucauug

SEQ ID NO: 14107 - RNA, 27 nt, Artificial Sequence
  Synthetic oligonucleotide
cacuaccuggaaacaggaaaucauugg

SEQ ID NO: 14108 - RNA, 27 nt, Artificial Sequence
  Synthetic oligonucleotide
acuaccuggaaacaggaaaucauugga

SEQ ID NO: 14109 - RNA, 27 nt, Artificial Sequence
  Synthetic oligonucleotide
cuaccuggaaacaggaaaucauuggaa

SEQ ID NO: 14110 - RNA, 27 nt, Artificial Sequence
  Synthetic oligonucleotide
uaccuggaaacaggaaaucauuggaac

SEQ ID NO: 14111 - RNA, 27 nt, Artificial Sequence
  Synthetic oligonucleotide
accuggaaacaggaaaucauuggaaca

SEQ ID NO: 14112 - RNA, 27 nt, Artificial Sequence
  Synthetic oligonucleotide
ccuggaaacaggaaaucauuggaacau

SEQ ID NO: 14113 - RNA, 27 nt, Artificial Sequence
  Synthetic oligonucleotide
cuggaaacaggaaaucauuggaacauu

SEQ ID NO: 14114 - RNA, 27 nt, Artificial Sequence
  Synthetic oligonucleotide
uggaaacaggaaaucauuggaacauuu

SEQ ID NO: 14115 - RNA, 27 nt, Artificial Sequence
  Synthetic oligonucleotide
ggaaacaggaaaucauuggaacauuuu

SEQ ID NO: 14116 - RNA, 27 nt, Artificial Sequence
  Synthetic oligonucleotide
gaaacaggaaaucauuggaacauuuuu

SEQ ID NO: 14117 - RNA, 27 nt, Artificial Sequence
  Synthetic oligonucleotide
aaacaggaaaucauuggaacauuuuuc

SEQ ID NO: 14118 - RNA, 27 nt, Artificial Sequence
  Synthetic oligonucleotide
aacaggaaaucauuggaacauuuuuca

SEQ ID NO: 14119 - RNA, 27 nt, Artificial Sequence
  Synthetic oligonucleotide
aggaaaucauuggaacauuuuucauuc

SEQ ID NO: 14120 - RNA, 27 nt, Artificial Sequence
  Synthetic oligonucleotide
ggaaaucauuggaacauuuuucauucu

SEQ ID NO: 14121 - RNA, 27 nt, Artificial Sequence
  Synthetic oligonucleotide
gaaaucauuggaacauuuuucauucug

SEQ ID NO: 14122 - RNA, 27 nt, Artificial Sequence
  Synthetic oligonucleotide
aaaucauuggaacauuuuucauucuga

SEQ ID NO: 14123 - RNA, 27 nt, Artificial Sequence
  Synthetic oligonucleotide
aaucauuggaacauuuuucauucugac

SEQ ID NO: 14124 - RNA, 27 nt, Artificial Sequence
  Synthetic oligonucleotide
aucauuggaacauuuuucauucugacc

SEQ ID NO: 14125 - RNA, 27 nt, Artificial Sequence
  Synthetic oligonucleotide
ucauuggaacauuuuucauucugaccc

SEQ ID NO: 14126 - RNA, 27 nt, Artificial Sequence
  Synthetic oligonucleotide
cugacccauuaauugaaaagcagaaac

SEQ ID NO: 14127 - RNA, 27 nt, Artificial Sequence
  Synthetic oligonucleotide
gaagaaaaaauuaaaagaagggauguu

SEQ ID NO: 14128 - RNA, 27 nt, Artificial Sequence
  Synthetic oligonucleotide
aagaaaaaauuaaaagaagggauguug

SEQ ID NO: 14129 - RNA, 27 nt, Artificial Sequence
  Synthetic oligonucleotide
agaaaaaauuaaaagaagggauguuga

SEQ ID NO: 14130 - RNA, 27 nt, Artificial Sequence
  Synthetic oligonucleotide
gaaaaaauuaaaagaagggauguugag

SEQ ID NO: 14131 - RNA, 27 nt, Artificial Sequence
  Synthetic oligonucleotide
aaaaaauuaaaagaagggauguugagc

SEQ ID NO: 14132 - RNA, 27 nt, Artificial Sequence
  Synthetic oligonucleotide
guugagcauuauguccuacagaaaugc

SEQ ID NO: 14133 - RNA, 27 nt, Artificial Sequence
  Synthetic oligonucleotide
ugagcauuauguccuacagaaaugcug

SEQ ID NO: 14134 - RNA, 27 nt, Artificial Sequence
  Synthetic oligonucleotide
gagcauuauguccuacagaaaugcuga

SEQ ID NO: 14135 - RNA, 27 nt, Artificial Sequence
  Synthetic oligonucleotide
agcauuauguccuacagaaaugcugac

SEQ ID NO: 14136 - RNA, 27 nt, Artificial Sequence
  Synthetic oligonucleotide
gcauuauguccuacagaaaugcugacu

SEQ ID NO: 14137 - RNA, 27 nt, Artificial Sequence
  Synthetic oligonucleotide
cauuauguccuacagaaaugcugacua

SEQ ID NO: 14138 - RNA, 27 nt, Artificial Sequence
  Synthetic oligonucleotide
auuauguccuacagaaaugcugacuac

SEQ ID NO: 14139 - RNA, 27 nt, Artificial Sequence
  Synthetic oligonucleotide
uuauguccuacagaaaugcugacuacu

SEQ ID NO: 14140 - RNA, 27 nt, Artificial Sequence
  Synthetic oligonucleotide
uauguccuacagaaaugcugacuacuc

SEQ ID NO: 14141 - RNA, 27 nt, Artificial Sequence
  Synthetic oligonucleotide
auguccuacagaaaugcugacuacucu

SEQ ID NO: 14142 - RNA, 27 nt, Artificial Sequence
  Synthetic oligonucleotide
uguccuacagaaaugcugacuacucuu

SEQ ID NO: 14143 - RNA, 27 nt, Artificial Sequence
  Synthetic oligonucleotide
guccuacagaaaugcugacuacucuua

SEQ ID NO: 14144 - RNA, 27 nt, Artificial Sequence
  Synthetic oligonucleotide
gaagugcuagcacuugguuaacagcuu

SEQ ID NO: 14145 - RNA, 27 nt, Artificial Sequence
  Synthetic oligonucleotide
aagugcuagcacuugguuaacagcuuu

SEQ ID NO: 14146 - RNA, 27 nt, Artificial Sequence
  Synthetic oligonucleotide
agugcuagcacuugguuaacagcuuuu

SEQ ID NO: 14147 - RNA, 27 nt, Artificial Sequence
  Synthetic oligonucleotide
gugcuagcacuugguuaacagcuuuug

SEQ ID NO: 14148 - RNA, 27 nt, Artificial Sequence
  Synthetic oligonucleotide
ugcuagcacuugguuaacagcuuuugc

SEQ ID NO: 14149 - RNA, 27 nt, Artificial Sequence
  Synthetic oligonucleotide
gcuagcacuugguuaacagcuuuugcu

SEQ ID NO: 14150 - RNA, 27 nt, Artificial Sequence
  Synthetic oligonucleotide
cuagcacuugguuaacagcuuuugcuu

SEQ ID NO: 14151 - RNA, 27 nt, Artificial Sequence
  Synthetic oligonucleotide
uagcacuugguuaacagcuuuugcuuu

SEQ ID NO: 14152 - RNA, 27 nt, Artificial Sequence
  Synthetic oligonucleotide
agcacuugguuaacagcuuuugcuuua

SEQ ID NO: 14153 - RNA, 27 nt, Artificial Sequence
  Synthetic oligonucleotide
gcacuugguuaacagcuuuugcuuuaa

SEQ ID NO: 14154 - RNA, 27 nt, Artificial Sequence
  Synthetic oligonucleotide
acuugguuaacagcuuuugcuuuaaga

SEQ ID NO: 14155 - RNA, 27 nt, Artificial Sequence
  Synthetic oligonucleotide
cuugguuaacagcuuuugcuuuaagag

SEQ ID NO: 14156 - RNA, 27 nt, Artificial Sequence
  Synthetic oligonucleotide
gguuaacagcuuuugcuuuaagaguac

SEQ ID NO: 14157 - RNA, 27 nt, Artificial Sequence
  Synthetic oligonucleotide
guuaacagcuuuugcuuuaagaguacu

SEQ ID NO: 14158 - RNA, 27 nt, Artificial Sequence
  Synthetic oligonucleotide
uuaacagcuuuugcuuuaagaguacuu

SEQ ID NO: 14159 - RNA, 27 nt, Artificial Sequence
  Synthetic oligonucleotide
uaacagcuuuugcuuuaagaguacuug

SEQ ID NO: 14160 - RNA, 27 nt, Artificial Sequence
  Synthetic oligonucleotide
aacagcuuuugcuuuaagaguacuugg

SEQ ID NO: 14161 - RNA, 27 nt, Artificial Sequence
  Synthetic oligonucleotide
acagcuuuugcuuuaagaguacuugga

SEQ ID NO: 14162 - RNA, 27 nt, Artificial Sequence
  Synthetic oligonucleotide
cagcuuuugcuuuaagaguacuuggac

SEQ ID NO: 14163 - RNA, 27 nt, Artificial Sequence
  Synthetic oligonucleotide
agcuuuugcuuuaagaguacuuggaca

SEQ ID NO: 14164 - RNA, 27 nt, Artificial Sequence
  Synthetic oligonucleotide
gcuuuugcuuuaagaguacuuggacaa

SEQ ID NO: 14165 - RNA, 27 nt, Artificial Sequence
  Synthetic oligonucleotide
cuuuugcuuuaagaguacuuggacaag

SEQ ID NO: 14166 - RNA, 27 nt, Artificial Sequence
  Synthetic oligonucleotide
uuuugcuuuaagaguacuuggacaagu

SEQ ID NO: 14167 - RNA, 27 nt, Artificial Sequence
  Synthetic oligonucleotide
uuugcuuuaagaguacuuggacaagua

SEQ ID NO: 14168 - RNA, 27 nt, Artificial Sequence
  Synthetic oligonucleotide
gcuuuaagaguacuuggacaaguaaau

SEQ ID NO: 14169 - RNA, 27 nt, Artificial Sequence
  Synthetic oligonucleotide
cuuuaagaguacuuggacaaguaaaua

SEQ ID NO: 14170 - RNA, 27 nt, Artificial Sequence
  Synthetic oligonucleotide
acguagagcagaaccaaaauucaauuu

SEQ ID NO: 14171 - RNA, 27 nt, Artificial Sequence
  Synthetic oligonucleotide
uuuguaauucuuuauuguggcuaguug

SEQ ID NO: 14172 - RNA, 27 nt, Artificial Sequence
  Synthetic oligonucleotide
uuguaauucuuuauuguggcuaguuga

SEQ ID NO: 14173 - RNA, 27 nt, Artificial Sequence
  Synthetic oligonucleotide
cuuucaaggaaaauucacaguaucaac

SEQ ID NO: 14174 - RNA, 27 nt, Artificial Sequence
  Synthetic oligonucleotide
uuucaaggaaaauucacaguaucaacc

SEQ ID NO: 14175 - RNA, 27 nt, Artificial Sequence
  Synthetic oligonucleotide
uucaaggaaaauucacaguaucaacca

SEQ ID NO: 14176 - RNA, 27 nt, Artificial Sequence
  Synthetic oligonucleotide
ucaaggaaaauucacaguaucaaccaa

SEQ ID NO: 14177 - RNA, 27 nt, Artificial Sequence
  Synthetic oligonucleotide
caaggaaaauucacaguaucaaccaau

SEQ ID NO: 14178 - RNA, 27 nt, Artificial Sequence
  Synthetic oligonucleotide
aaggaaaauucacaguaucaaccaaua

SEQ ID NO: 14179 - RNA, 27 nt, Artificial Sequence
  Synthetic oligonucleotide
aggaaaauucacaguaucaaccaauaa

SEQ ID NO: 14180 - RNA, 27 nt, Artificial Sequence
  Synthetic oligonucleotide
ggaaaauucacaguaucaaccaauaaa

SEQ ID NO: 14181 - RNA, 27 nt, Artificial Sequence
  Synthetic oligonucleotide
gaaaauucacaguaucaaccaauaaaa

SEQ ID NO: 14182 - RNA, 27 nt, Artificial Sequence
  Synthetic oligonucleotide
aaaauucacaguaucaaccaauaaaau

SEQ ID NO: 14183 - RNA, 27 nt, Artificial Sequence
  Synthetic oligonucleotide
aaauucacaguaucaaccaauaaaauu

SEQ ID NO: 14184 - RNA, 27 nt, Artificial Sequence
  Synthetic oligonucleotide
aauucacaguaucaaccaauaaaauua

SEQ ID NO: 14185 - RNA, 27 nt, Artificial Sequence
  Synthetic oligonucleotide
auucacaguaucaaccaauaaaauuac

SEQ ID NO: 14186 - RNA, 27 nt, Artificial Sequence
  Synthetic oligonucleotide
ucacaguaucaaccaauaaaauuacag

SEQ ID NO: 14187 - RNA, 27 nt, Artificial Sequence
  Synthetic oligonucleotide
cacaguaucaaccaauaaaauuacagg

SEQ ID NO: 14188 - RNA, 27 nt, Artificial Sequence
  Synthetic oligonucleotide
acaguaucaaccaauaaaauuacaggg

SEQ ID NO: 14189 - RNA, 27 nt, Artificial Sequence
  Synthetic oligonucleotide
caguaucaaccaauaaaauuacagggu

SEQ ID NO: 14190 - RNA, 27 nt, Artificial Sequence
  Synthetic oligonucleotide
aguaucaaccaauaaaauuacagggua

SEQ ID NO: 14191 - RNA, 27 nt, Artificial Sequence
  Synthetic oligonucleotide
guaucaaccaauaaaauuacaggguac

SEQ ID NO: 14192 - RNA, 27 nt, Artificial Sequence
  Synthetic oligonucleotide
uaucaaccaauaaaauuacaggguacc

SEQ ID NO: 14193 - RNA, 27 nt, Artificial Sequence
  Synthetic oligonucleotide
cacagcucuaauuaaagcugacaacuu

SEQ ID NO: 14194 - RNA, 27 nt, Artificial Sequence
  Synthetic oligonucleotide
acagcucuaauuaaagcugacaacuuu

SEQ ID NO: 14195 - RNA, 27 nt, Artificial Sequence
  Synthetic oligonucleotide
cagcucuaauuaaagcugacaacuuuc

SEQ ID NO: 14196 - RNA, 27 nt, Artificial Sequence
  Synthetic oligonucleotide
aacuuucugcuugaaaauacacugcca

SEQ ID NO: 14197 - RNA, 27 nt, Artificial Sequence
  Synthetic oligonucleotide
acuuucugcuugaaaauacacugccag

SEQ ID NO: 14198 - RNA, 27 nt, Artificial Sequence
  Synthetic oligonucleotide
cuuucugcuugaaaauacacugccagc

SEQ ID NO: 14199 - RNA, 27 nt, Artificial Sequence
  Synthetic oligonucleotide
uuucugcuugaaaauacacugccagcc

SEQ ID NO: 14200 - RNA, 27 nt, Artificial Sequence
  Synthetic oligonucleotide
uucugcuugaaaauacacugccagccc

SEQ ID NO: 14201 - RNA, 27 nt, Artificial Sequence
  Synthetic oligonucleotide
ucugcuugaaaauacacugccagccca

SEQ ID NO: 14202 - RNA, 27 nt, Artificial Sequence
  Synthetic oligonucleotide
cugcuugaaaauacacugccagcccag

SEQ ID NO: 14203 - RNA, 27 nt, Artificial Sequence
  Synthetic oligonucleotide
ugcuugaaaauacacugccagcccaga

SEQ ID NO: 14204 - RNA, 27 nt, Artificial Sequence
  Synthetic oligonucleotide
gcuugaaaauacacugccagcccagag

SEQ ID NO: 14205 - RNA, 27 nt, Artificial Sequence
  Synthetic oligonucleotide
cuugaaaauacacugccagcccagagc

SEQ ID NO: 14206 - RNA, 27 nt, Artificial Sequence
  Synthetic oligonucleotide
uugaaaauacacugccagcccagagca

SEQ ID NO: 14207 - RNA, 27 nt, Artificial Sequence
  Synthetic oligonucleotide
ugaaaauacacugccagcccagagcac

SEQ ID NO: 14208 - RNA, 27 nt, Artificial Sequence
  Synthetic oligonucleotide
gaaaauacacugccagcccagagcacc

SEQ ID NO: 14209 - RNA, 27 nt, Artificial Sequence
  Synthetic oligonucleotide
aaaauacacugccagcccagagcaccu

SEQ ID NO: 14210 - RNA, 27 nt, Artificial Sequence
  Synthetic oligonucleotide
aaauacacugccagcccagagcaccuu

SEQ ID NO: 14211 - RNA, 27 nt, Artificial Sequence
  Synthetic oligonucleotide
aauacacugccagcccagagcaccuuu

SEQ ID NO: 14212 - RNA, 27 nt, Artificial Sequence
  Synthetic oligonucleotide
auacacugccagcccagagcaccuuua

SEQ ID NO: 14213 - RNA, 27 nt, Artificial Sequence
  Synthetic oligonucleotide
uacacugccagcccagagcaccuuuac

SEQ ID NO: 14214 - RNA, 27 nt, Artificial Sequence
  Synthetic oligonucleotide
acacugccagcccagagcaccuuuaca

SEQ ID NO: 14215 - RNA, 27 nt, Artificial Sequence
  Synthetic oligonucleotide
cacugccagcccagagcaccuuuacau

SEQ ID NO: 14216 - RNA, 27 nt, Artificial Sequence
  Synthetic oligonucleotide
acugccagcccagagcaccuuuacauu

SEQ ID NO: 14217 - RNA, 27 nt, Artificial Sequence
  Synthetic oligonucleotide
cugccagcccagagcaccuuuacauug

SEQ ID NO: 14218 - RNA, 27 nt, Artificial Sequence
  Synthetic oligonucleotide
ugccagcccagagcaccuuuacauugg

SEQ ID NO: 14219 - RNA, 27 nt, Artificial Sequence
  Synthetic oligonucleotide
gccagcccagagcaccuuuacauuggc

SEQ ID NO: 14220 - RNA, 27 nt, Artificial Sequence
  Synthetic oligonucleotide
ccagcccagagcaccuuuacauuggcc

SEQ ID NO: 14221 - RNA, 27 nt, Artificial Sequence
  Synthetic oligonucleotide
cagcccagagcaccuuuacauuggcca

SEQ ID NO: 14222 - RNA, 27 nt, Artificial Sequence
  Synthetic oligonucleotide
agcccagagcaccuuuacauuggccau

SEQ ID NO: 14223 - RNA, 27 nt, Artificial Sequence
  Synthetic oligonucleotide
gcccagagcaccuuuacauuggccauu

SEQ ID NO: 14224 - RNA, 27 nt, Artificial Sequence
  Synthetic oligonucleotide
cccagagcaccuuuacauuggccauuu

SEQ ID NO: 14225 - RNA, 27 nt, Artificial Sequence
  Synthetic oligonucleotide
ccagagcaccuuuacauuggccauuuc

SEQ ID NO: 14226 - RNA, 27 nt, Artificial Sequence
  Synthetic oligonucleotide
cagagcaccuuuacauuggccauuucu

SEQ ID NO: 14227 - RNA, 27 nt, Artificial Sequence
  Synthetic oligonucleotide
agagcaccuuuacauuggccauuucug

SEQ ID NO: 14228 - RNA, 27 nt, Artificial Sequence
  Synthetic oligonucleotide
gagcaccuuuacauuggccauuucugc

SEQ ID NO: 14229 - RNA, 27 nt, Artificial Sequence
  Synthetic oligonucleotide
agcaccuuuacauuggccauuucugcg

SEQ ID NO: 14230 - RNA, 27 nt, Artificial Sequence
  Synthetic oligonucleotide
gcaccuuuacauuggccauuucugcgu

SEQ ID NO: 14231 - RNA, 27 nt, Artificial Sequence
  Synthetic oligonucleotide
caccuuuacauuggccauuucugcgua

SEQ ID NO: 14232 - RNA, 27 nt, Artificial Sequence
  Synthetic oligonucleotide
accuuuacauuggccauuucugcguau

SEQ ID NO: 14233 - RNA, 27 nt, Artificial Sequence
  Synthetic oligonucleotide
ccuuuacauuggccauuucugcguaug

SEQ ID NO: 14234 - RNA, 27 nt, Artificial Sequence
  Synthetic oligonucleotide
cuuuacauuggccauuucugcguaugc

SEQ ID NO: 14235 - RNA, 27 nt, Artificial Sequence
  Synthetic oligonucleotide
cguaugcucuuucccugggagauaaaa

SEQ ID NO: 14236 - RNA, 27 nt, Artificial Sequence
  Synthetic oligonucleotide
guaugcucuuucccugggagauaaaac

SEQ ID NO: 14237 - RNA, 27 nt, Artificial Sequence
  Synthetic oligonucleotide
uaugcucuuucccugggagauaaaacu

SEQ ID NO: 14238 - RNA, 27 nt, Artificial Sequence
  Synthetic oligonucleotide
augcucuuucccugggagauaaaacuc

SEQ ID NO: 14239 - RNA, 27 nt, Artificial Sequence
  Synthetic oligonucleotide
ugcucuuucccugggagauaaaacuca

SEQ ID NO: 14240 - RNA, 27 nt, Artificial Sequence
  Synthetic oligonucleotide
gcucuuucccugggagauaaaacucac

SEQ ID NO: 14241 - RNA, 27 nt, Artificial Sequence
  Synthetic oligonucleotide
cucuuucccugggagauaaaacucacc

SEQ ID NO: 14242 - RNA, 27 nt, Artificial Sequence
  Synthetic oligonucleotide
ucuuucccugggagauaaaacucaccc

SEQ ID NO: 14243 - RNA, 27 nt, Artificial Sequence
  Synthetic oligonucleotide
cuuucccugggagauaaaacucaccca

SEQ ID NO: 14244 - RNA, 27 nt, Artificial Sequence
  Synthetic oligonucleotide
uuucccugggagauaaaacucacccac

SEQ ID NO: 14245 - RNA, 27 nt, Artificial Sequence
  Synthetic oligonucleotide
uucccugggagauaaaacucacccaca

SEQ ID NO: 14246 - RNA, 27 nt, Artificial Sequence
  Synthetic oligonucleotide
ucccugggagauaaaacucacccacag

SEQ ID NO: 14247 - RNA, 27 nt, Artificial Sequence
  Synthetic oligonucleotide
cccugggagauaaaacucacccacagu

SEQ ID NO: 14248 - RNA, 27 nt, Artificial Sequence
  Synthetic oligonucleotide
ccugggagauaaaacucacccacaguu

SEQ ID NO: 14249 - RNA, 27 nt, Artificial Sequence
  Synthetic oligonucleotide
cugggagauaaaacucacccacaguuu

SEQ ID NO: 14250 - RNA, 27 nt, Artificial Sequence
  Synthetic oligonucleotide
ugggagauaaaacucacccacaguuuc

SEQ ID NO: 14251 - RNA, 27 nt, Artificial Sequence
  Synthetic oligonucleotide
gggagauaaaacucacccacaguuucg

SEQ ID NO: 14252 - RNA, 27 nt, Artificial Sequence
  Synthetic oligonucleotide
ggagauaaaacucacccacaguuucgu

SEQ ID NO: 14253 - RNA, 27 nt, Artificial Sequence
  Synthetic oligonucleotide
gagauaaaacucacccacaguuucguu

SEQ ID NO: 14254 - RNA, 27 nt, Artificial Sequence
  Synthetic oligonucleotide
agauaaaacucacccacaguuucguuc

SEQ ID NO: 14255 - RNA, 27 nt, Artificial Sequence
  Synthetic oligonucleotide
gauaaaacucacccacaguuucguuca

SEQ ID NO: 14256 - RNA, 27 nt, Artificial Sequence
  Synthetic oligonucleotide
ucguucaauuguuucagcuuugaagag

SEQ ID NO: 14257 - RNA, 27 nt, Artificial Sequence
  Synthetic oligonucleotide
guucaauuguuucagcuuugaagagag

SEQ ID NO: 14258 - RNA, 27 nt, Artificial Sequence
  Synthetic oligonucleotide
uucaauuguuucagcuuugaagagaga

SEQ ID NO: 14259 - RNA, 27 nt, Artificial Sequence
  Synthetic oligonucleotide
ucaauuguuucagcuuugaagagagaa

SEQ ID NO: 14260 - RNA, 27 nt, Artificial Sequence
  Synthetic oligonucleotide
caauuguuucagcuuugaagagagaag

SEQ ID NO: 14261 - RNA, 27 nt, Artificial Sequence
  Synthetic oligonucleotide
aauuguuucagcuuugaagagagaagc

SEQ ID NO: 14262 - RNA, 27 nt, Artificial Sequence
  Synthetic oligonucleotide
auuguuucagcuuugaagagagaagcu

SEQ ID NO: 14263 - RNA, 27 nt, Artificial Sequence
  Synthetic oligonucleotide
uuguuucagcuuugaagagagaagcuu

SEQ ID NO: 14264 - RNA, 27 nt, Artificial Sequence
  Synthetic oligonucleotide
uguuucagcuuugaagagagaagcuuu

SEQ ID NO: 14265 - RNA, 27 nt, Artificial Sequence
  Synthetic oligonucleotide
guuucagcuuugaagagagaagcuuug

SEQ ID NO: 14266 - RNA, 27 nt, Artificial Sequence
  Synthetic oligonucleotide
uuucagcuuugaagagagaagcuuugg

SEQ ID NO: 14267 - RNA, 27 nt, Artificial Sequence
  Synthetic oligonucleotide
uucagcuuugaagagagaagcuuuggu

SEQ ID NO: 14268 - RNA, 27 nt, Artificial Sequence
  Synthetic oligonucleotide
ucagcuuugaagagagaagcuuugguu

SEQ ID NO: 14269 - RNA, 27 nt, Artificial Sequence
  Synthetic oligonucleotide
cagcuuugaagagagaagcuuugguua

SEQ ID NO: 14270 - RNA, 27 nt, Artificial Sequence
  Synthetic oligonucleotide
agcuuugaagagagaagcuuugguuaa

SEQ ID NO: 14271 - RNA, 27 nt, Artificial Sequence
  Synthetic oligonucleotide
gcuuugaagagagaagcuuugguuaaa

SEQ ID NO: 14272 - RNA, 27 nt, Artificial Sequence
  Synthetic oligonucleotide
cuuugaagagagaagcuuugguuaaag

SEQ ID NO: 14273 - RNA, 27 nt, Artificial Sequence
  Synthetic oligonucleotide
uuugaagagagaagcuuugguuaaagg

SEQ ID NO: 14274 - RNA, 27 nt, Artificial Sequence
  Synthetic oligonucleotide
aagagagaagcuuugguuaaagguaau

SEQ ID NO: 14275 - RNA, 27 nt, Artificial Sequence
  Synthetic oligonucleotide
agagagaagcuuugguuaaagguaauc

SEQ ID NO: 14276 - RNA, 27 nt, Artificial Sequence
  Synthetic oligonucleotide
gagagaagcuuugguuaaagguaaucc

SEQ ID NO: 14277 - RNA, 27 nt, Artificial Sequence
  Synthetic oligonucleotide
agaagcuuugguuaaagguaauccacc

SEQ ID NO: 14278 - RNA, 27 nt, Artificial Sequence
  Synthetic oligonucleotide
gaagcuuugguuaaagguaauccaccc

SEQ ID NO: 14279 - RNA, 27 nt, Artificial Sequence
  Synthetic oligonucleotide
aagcuuugguuaaagguaauccaccca

SEQ ID NO: 14280 - RNA, 27 nt, Artificial Sequence
  Synthetic oligonucleotide
agcuuugguuaaagguaauccacccau

SEQ ID NO: 14281 - RNA, 27 nt, Artificial Sequence
  Synthetic oligonucleotide
gcuuugguuaaagguaauccacccauu

SEQ ID NO: 14282 - RNA, 27 nt, Artificial Sequence
  Synthetic oligonucleotide
cuuugguuaaagguaauccacccauuu

SEQ ID NO: 14283 - RNA, 27 nt, Artificial Sequence
  Synthetic oligonucleotide
uuugguuaaagguaauccacccauuua

SEQ ID NO: 14284 - RNA, 27 nt, Artificial Sequence
  Synthetic oligonucleotide
uugguuaaagguaauccacccauuuau

SEQ ID NO: 14285 - RNA, 27 nt, Artificial Sequence
  Synthetic oligonucleotide
ugguuaaagguaauccacccauuuauc

SEQ ID NO: 14286 - RNA, 27 nt, Artificial Sequence
  Synthetic oligonucleotide
gguuaaagguaauccacccauuuaucg

SEQ ID NO: 14287 - RNA, 27 nt, Artificial Sequence
  Synthetic oligonucleotide
guuaaagguaauccacccauuuaucgu

SEQ ID NO: 14288 - RNA, 27 nt, Artificial Sequence
  Synthetic oligonucleotide
uuaaagguaauccacccauuuaucguu

SEQ ID NO: 14289 - RNA, 27 nt, Artificial Sequence
  Synthetic oligonucleotide
uaaagguaauccacccauuuaucguuu

SEQ ID NO: 14290 - RNA, 27 nt, Artificial Sequence
  Synthetic oligonucleotide
aaagguaauccacccauuuaucguuuu

SEQ ID NO: 14291 - RNA, 27 nt, Artificial Sequence
  Synthetic oligonucleotide
aagguaauccacccauuuaucguuuuu

SEQ ID NO: 14292 - RNA, 27 nt, Artificial Sequence
  Synthetic oligonucleotide
agguaauccacccauuuaucguuuuug

SEQ ID NO: 14293 - RNA, 27 nt, Artificial Sequence
  Synthetic oligonucleotide
gguaauccacccauuuaucguuuuugg

SEQ ID NO: 14294 - RNA, 27 nt, Artificial Sequence
  Synthetic oligonucleotide
guaauccacccauuuaucguuuuugga

SEQ ID NO: 14295 - RNA, 27 nt, Artificial Sequence
  Synthetic oligonucleotide
uaauccacccauuuaucguuuuuggaa

SEQ ID NO: 14296 - RNA, 27 nt, Artificial Sequence
  Synthetic oligonucleotide
aauccacccauuuaucguuuuuggaaa

SEQ ID NO: 14297 - RNA, 27 nt, Artificial Sequence
  Synthetic oligonucleotide
auccacccauuuaucguuuuuggaaag

SEQ ID NO: 14298 - RNA, 27 nt, Artificial Sequence
  Synthetic oligonucleotide
uccacccauuuaucguuuuuggaaaga

SEQ ID NO: 14299 - RNA, 27 nt, Artificial Sequence
  Synthetic oligonucleotide
ccacccauuuaucguuuuuggaaagac

SEQ ID NO: 14300 - RNA, 27 nt, Artificial Sequence
  Synthetic oligonucleotide
cacccauuuaucguuuuuggaaagaca

SEQ ID NO: 14301 - RNA, 27 nt, Artificial Sequence
  Synthetic oligonucleotide
cccauuuaucguuuuuggaaagacaau

SEQ ID NO: 14302 - RNA, 27 nt, Artificial Sequence
  Synthetic oligonucleotide
ccauuuaucguuuuuggaaagacaauc

SEQ ID NO: 14303 - RNA, 27 nt, Artificial Sequence
  Synthetic oligonucleotide
cauuuaucguuuuuggaaagacaaucu

SEQ ID NO: 14304 - RNA, 27 nt, Artificial Sequence
  Synthetic oligonucleotide
auuuaucguuuuuggaaagacaaucuu

SEQ ID NO: 14305 - RNA, 27 nt, Artificial Sequence
  Synthetic oligonucleotide
uuuaucguuuuuggaaagacaaucuuc

SEQ ID NO: 14306 - RNA, 27 nt, Artificial Sequence
  Synthetic oligonucleotide
agcauaaagacagcucuguaccuaaca

SEQ ID NO: 14307 - RNA, 27 nt, Artificial Sequence
  Synthetic oligonucleotide
gcauaaagacagcucuguaccuaacac

SEQ ID NO: 14308 - RNA, 27 nt, Artificial Sequence
  Synthetic oligonucleotide
cauaaagacagcucuguaccuaacacu

SEQ ID NO: 14309 - RNA, 27 nt, Artificial Sequence
  Synthetic oligonucleotide
auaaagacagcucuguaccuaacacug

SEQ ID NO: 14310 - RNA, 27 nt, Artificial Sequence
  Synthetic oligonucleotide
uaaagacagcucuguaccuaacacugg

SEQ ID NO: 14311 - RNA, 27 nt, Artificial Sequence
  Synthetic oligonucleotide
aaagacagcucuguaccuaacacuggu

SEQ ID NO: 14312 - RNA, 27 nt, Artificial Sequence
  Synthetic oligonucleotide
aagacagcucuguaccuaacacuggua

SEQ ID NO: 14313 - RNA, 27 nt, Artificial Sequence
  Synthetic oligonucleotide
agacagcucuguaccuaacacugguac

SEQ ID NO: 14314 - RNA, 27 nt, Artificial Sequence
  Synthetic oligonucleotide
gacagcucuguaccuaacacugguacg

SEQ ID NO: 14315 - RNA, 27 nt, Artificial Sequence
  Synthetic oligonucleotide
acagcucuguaccuaacacugguacgg

SEQ ID NO: 14316 - RNA, 27 nt, Artificial Sequence
  Synthetic oligonucleotide
cagcucuguaccuaacacugguacggc

SEQ ID NO: 14317 - RNA, 27 nt, Artificial Sequence
  Synthetic oligonucleotide
agcucuguaccuaacacugguacggca

SEQ ID NO: 14318 - RNA, 27 nt, Artificial Sequence
  Synthetic oligonucleotide
gcucuguaccuaacacugguacggcac

SEQ ID NO: 14319 - RNA, 27 nt, Artificial Sequence
  Synthetic oligonucleotide
cucuguaccuaacacugguacggcacg

SEQ ID NO: 14320 - RNA, 27 nt, Artificial Sequence
  Synthetic oligonucleotide
cggcacguaugguagaaacaacugccu

SEQ ID NO: 14321 - RNA, 27 nt, Artificial Sequence
  Synthetic oligonucleotide
ggcacguaugguagaaacaacugccua

SEQ ID NO: 14322 - RNA, 27 nt, Artificial Sequence
  Synthetic oligonucleotide
gcacguaugguagaaacaacugccuau

SEQ ID NO: 14323 - RNA, 27 nt, Artificial Sequence
  Synthetic oligonucleotide
cacguaugguagaaacaacugccuaug

SEQ ID NO: 14324 - RNA, 27 nt, Artificial Sequence
  Synthetic oligonucleotide
acguaugguagaaacaacugccuaugc

SEQ ID NO: 14325 - RNA, 27 nt, Artificial Sequence
  Synthetic oligonucleotide
cguaugguagaaacaacugccuaugcu

SEQ ID NO: 14326 - RNA, 27 nt, Artificial Sequence
  Synthetic oligonucleotide
guaugguagaaacaacugccuaugcuu

SEQ ID NO: 14327 - RNA, 27 nt, Artificial Sequence
  Synthetic oligonucleotide
uaugguagaaacaacugccuaugcuuu

SEQ ID NO: 14328 - RNA, 27 nt, Artificial Sequence
  Synthetic oligonucleotide
augguagaaacaacugccuaugcuuua

SEQ ID NO: 14329 - RNA, 27 nt, Artificial Sequence
  Synthetic oligonucleotide
ugguagaaacaacugccuaugcuuuac

SEQ ID NO: 14330 - RNA, 27 nt, Artificial Sequence
  Synthetic oligonucleotide
gguagaaacaacugccuaugcuuuacu

SEQ ID NO: 14331 - RNA, 27 nt, Artificial Sequence
  Synthetic oligonucleotide
guagaaacaacugccuaugcuuuacuc

SEQ ID NO: 14332 - RNA, 27 nt, Artificial Sequence
  Synthetic oligonucleotide
uagaaacaacugccuaugcuuuacuca

SEQ ID NO: 14333 - RNA, 27 nt, Artificial Sequence
  Synthetic oligonucleotide
agaaacaacugccuaugcuuuacucac

SEQ ID NO: 14334 - RNA, 27 nt, Artificial Sequence
  Synthetic oligonucleotide
gaaacaacugccuaugcuuuacucacc

SEQ ID NO: 14335 - RNA, 27 nt, Artificial Sequence
  Synthetic oligonucleotide
aaacaacugccuaugcuuuacucacca

SEQ ID NO: 14336 - RNA, 27 nt, Artificial Sequence
  Synthetic oligonucleotide
aacaacugccuaugcuuuacucaccag

SEQ ID NO: 14337 - RNA, 27 nt, Artificial Sequence
  Synthetic oligonucleotide
acaacugccuaugcuuuacucaccagu

SEQ ID NO: 14338 - RNA, 27 nt, Artificial Sequence
  Synthetic oligonucleotide
caacugccuaugcuuuacucaccaguc

SEQ ID NO: 14339 - RNA, 27 nt, Artificial Sequence
  Synthetic oligonucleotide
aacugccuaugcuuuacucaccagucu

SEQ ID NO: 14340 - RNA, 27 nt, Artificial Sequence
  Synthetic oligonucleotide
acugccuaugcuuuacucaccagucug

SEQ ID NO: 14341 - RNA, 27 nt, Artificial Sequence
  Synthetic oligonucleotide
cugccuaugcuuuacucaccagucuga

SEQ ID NO: 14342 - RNA, 27 nt, Artificial Sequence
  Synthetic oligonucleotide
ugccuaugcuuuacucaccagucugaa

SEQ ID NO: 14343 - RNA, 27 nt, Artificial Sequence
  Synthetic oligonucleotide
gccuaugcuuuacucaccagucugaac

SEQ ID NO: 14344 - RNA, 27 nt, Artificial Sequence
  Synthetic oligonucleotide
ccuaugcuuuacucaccagucugaacu

SEQ ID NO: 14345 - RNA, 27 nt, Artificial Sequence
  Synthetic oligonucleotide
cuaugcuuuacucaccagucugaacuu

SEQ ID NO: 14346 - RNA, 27 nt, Artificial Sequence
  Synthetic oligonucleotide
uaugcuuuacucaccagucugaacuug

SEQ ID NO: 14347 - RNA, 27 nt, Artificial Sequence
  Synthetic oligonucleotide
gcuuuacucaccagucugaacuugaaa

SEQ ID NO: 14348 - RNA, 27 nt, Artificial Sequence
  Synthetic oligonucleotide
cuuuacucaccagucugaacuugaaag

SEQ ID NO: 14349 - RNA, 27 nt, Artificial Sequence
  Synthetic oligonucleotide
uuuacucaccagucugaacuugaaaga

SEQ ID NO: 14350 - RNA, 27 nt, Artificial Sequence
  Synthetic oligonucleotide
uuacucaccagucugaacuugaaagau

SEQ ID NO: 14351 - RNA, 27 nt, Artificial Sequence
  Synthetic oligonucleotide
acucaccagucugaacuugaaagauau

SEQ ID NO: 14352 - RNA, 27 nt, Artificial Sequence
  Synthetic oligonucleotide
cucaccagucugaacuugaaagauaua

SEQ ID NO: 14353 - RNA, 27 nt, Artificial Sequence
  Synthetic oligonucleotide
ucaccagucugaacuugaaagauauaa

SEQ ID NO: 14354 - RNA, 27 nt, Artificial Sequence
  Synthetic oligonucleotide
agucaucaaauggcuaucagaagagca

SEQ ID NO: 14355 - RNA, 27 nt, Artificial Sequence
  Synthetic oligonucleotide
gucaucaaauggcuaucagaagagcag

SEQ ID NO: 14356 - RNA, 27 nt, Artificial Sequence
  Synthetic oligonucleotide
ucaucaaauggcuaucagaagagcaga

SEQ ID NO: 14357 - RNA, 27 nt, Artificial Sequence
  Synthetic oligonucleotide
caucaaauggcuaucagaagagcagag

SEQ ID NO: 14358 - RNA, 27 nt, Artificial Sequence
  Synthetic oligonucleotide
aucaaauggcuaucagaagagcagagg

SEQ ID NO: 14359 - RNA, 27 nt, Artificial Sequence
  Synthetic oligonucleotide
ucaaauggcuaucagaagagcagaggu

SEQ ID NO: 14360 - RNA, 27 nt, Artificial Sequence
  Synthetic oligonucleotide
caaauggcuaucagaagagcagaggua

SEQ ID NO: 14361 - RNA, 27 nt, Artificial Sequence
  Synthetic oligonucleotide
aaauggcuaucagaagagcagagguau

SEQ ID NO: 14362 - RNA, 27 nt, Artificial Sequence
  Synthetic oligonucleotide
aauggcuaucagaagagcagagguaug

SEQ ID NO: 14363 - RNA, 27 nt, Artificial Sequence
  Synthetic oligonucleotide
auggcuaucagaagagcagagguaugg

SEQ ID NO: 14364 - RNA, 27 nt, Artificial Sequence
  Synthetic oligonucleotide
uggcuaucagaagagcagagguaugga

SEQ ID NO: 14365 - RNA, 27 nt, Artificial Sequence
  Synthetic oligonucleotide
ggcuaucagaagagcagagguauggag

SEQ ID NO: 14366 - RNA, 27 nt, Artificial Sequence
  Synthetic oligonucleotide
gcuaucagaagagcagagguauggagg

SEQ ID NO: 14367 - RNA, 27 nt, Artificial Sequence
  Synthetic oligonucleotide
cuaucagaagagcagagguauggaggu

SEQ ID NO: 14368 - RNA, 27 nt, Artificial Sequence
  Synthetic oligonucleotide
uaucagaagagcagagguauggaggug

SEQ ID NO: 14369 - RNA, 27 nt, Artificial Sequence
  Synthetic oligonucleotide
aucagaagagcagagguauggaggugg

SEQ ID NO: 14370 - RNA, 27 nt, Artificial Sequence
  Synthetic oligonucleotide
ucagaagagcagagguauggagguggc

SEQ ID NO: 14371 - RNA, 27 nt, Artificial Sequence
  Synthetic oligonucleotide
gaagagcagagguauggagguggcuuu

SEQ ID NO: 14372 - RNA, 27 nt, Artificial Sequence
  Synthetic oligonucleotide
aagagcagagguauggagguggcuuuu

SEQ ID NO: 14373 - RNA, 27 nt, Artificial Sequence
  Synthetic oligonucleotide
agagcagagguauggagguggcuuuua

SEQ ID NO: 14374 - RNA, 27 nt, Artificial Sequence
  Synthetic oligonucleotide
gagcagagguauggagguggcuuuuau

SEQ ID NO: 14375 - RNA, 27 nt, Artificial Sequence
  Synthetic oligonucleotide
agcagagguauggagguggcuuuuauu

SEQ ID NO: 14376 - RNA, 27 nt, Artificial Sequence
  Synthetic oligonucleotide
gcagagguauggagguggcuuuuauuc

SEQ ID NO: 14377 - RNA, 27 nt, Artificial Sequence
  Synthetic oligonucleotide
cagagguauggagguggcuuuuauuca

SEQ ID NO: 14378 - RNA, 27 nt, Artificial Sequence
  Synthetic oligonucleotide
agagguauggagguggcuuuuauucaa

SEQ ID NO: 14379 - RNA, 27 nt, Artificial Sequence
  Synthetic oligonucleotide
gagguauggagguggcuuuuauucaac

SEQ ID NO: 14380 - RNA, 27 nt, Artificial Sequence
  Synthetic oligonucleotide
agguauggagguggcuuuuauucaacc

SEQ ID NO: 14381 - RNA, 27 nt, Artificial Sequence
  Synthetic oligonucleotide
gguauggagguggcuuuuauucaaccc

SEQ ID NO: 14382 - RNA, 27 nt, Artificial Sequence
  Synthetic oligonucleotide
guauggagguggcuuuuauucaaccca

SEQ ID NO: 14383 - RNA, 27 nt, Artificial Sequence
  Synthetic oligonucleotide
uauggagguggcuuuuauucaacccag

SEQ ID NO: 14384 - RNA, 27 nt, Artificial Sequence
  Synthetic oligonucleotide
auggagguggcuuuuauucaacccagg

SEQ ID NO: 14385 - RNA, 27 nt, Artificial Sequence
  Synthetic oligonucleotide
uggagguggcuuuuauucaacccagga

SEQ ID NO: 14386 - RNA, 27 nt, Artificial Sequence
  Synthetic oligonucleotide
ggagguggcuuuuauucaacccaggac

SEQ ID NO: 14387 - RNA, 27 nt, Artificial Sequence
  Synthetic oligonucleotide
gagguggcuuuuauucaacccaggaca

SEQ ID NO: 14388 - RNA, 27 nt, Artificial Sequence
  Synthetic oligonucleotide
agguggcuuuuauucaacccaggacac

SEQ ID NO: 14389 - RNA, 27 nt, Artificial Sequence
  Synthetic oligonucleotide
ggaauauucacuccugguuaaacaacu

SEQ ID NO: 14390 - RNA, 27 nt, Artificial Sequence
  Synthetic oligonucleotide
gaauauucacuccugguuaaacaacuc

SEQ ID NO: 14391 - RNA, 27 nt, Artificial Sequence
  Synthetic oligonucleotide
aauauucacuccugguuaaacaacucc

SEQ ID NO: 14392 - RNA, 27 nt, Artificial Sequence
  Synthetic oligonucleotide
auauucacuccugguuaaacaacuccg

SEQ ID NO: 14393 - RNA, 27 nt, Artificial Sequence
  Synthetic oligonucleotide
gccuuacauaauuauaaaaugacagac

SEQ ID NO: 14394 - RNA, 27 nt, Artificial Sequence
  Synthetic oligonucleotide
ccuuacauaauuauaaaaugacagaca

SEQ ID NO: 14395 - RNA, 27 nt, Artificial Sequence
  Synthetic oligonucleotide
cuuacauaauuauaaaaugacagacaa

SEQ ID NO: 14396 - RNA, 27 nt, Artificial Sequence
  Synthetic oligonucleotide
uuacauaauuauaaaaugacagacaag

SEQ ID NO: 14397 - RNA, 27 nt, Artificial Sequence
  Synthetic oligonucleotide
uacauaauuauaaaaugacagacaaga

SEQ ID NO: 14398 - RNA, 27 nt, Artificial Sequence
  Synthetic oligonucleotide
acauaauuauaaaaugacagacaagaa

SEQ ID NO: 14399 - RNA, 27 nt, Artificial Sequence
  Synthetic oligonucleotide
cauaauuauaaaaugacagacaagaau

SEQ ID NO: 14400 - RNA, 27 nt, Artificial Sequence
  Synthetic oligonucleotide
auaauuauaaaaugacagacaagaauu

SEQ ID NO: 14401 - RNA, 27 nt, Artificial Sequence
  Synthetic oligonucleotide
uaauuauaaaaugacagacaagaauuu

SEQ ID NO: 14402 - RNA, 27 nt, Artificial Sequence
  Synthetic oligonucleotide
aauuauaaaaugacagacaagaauuuc

SEQ ID NO: 14403 - RNA, 27 nt, Artificial Sequence
  Synthetic oligonucleotide
auuauaaaaugacagacaagaauuucc

SEQ ID NO: 14404 - RNA, 27 nt, Artificial Sequence
  Synthetic oligonucleotide
uuauaaaaugacagacaagaauuuccu

SEQ ID NO: 14405 - RNA, 27 nt, Artificial Sequence
  Synthetic oligonucleotide
uauaaaaugacagacaagaauuuccuu

SEQ ID NO: 14406 - RNA, 27 nt, Artificial Sequence
  Synthetic oligonucleotide
auaaaaugacagacaagaauuuccuug

SEQ ID NO: 14407 - RNA, 27 nt, Artificial Sequence
  Synthetic oligonucleotide
uaaaaugacagacaagaauuuccuugg

SEQ ID NO: 14408 - RNA, 27 nt, Artificial Sequence
  Synthetic oligonucleotide
aaaaugacagacaagaauuuccuuggg

SEQ ID NO: 14409 - RNA, 27 nt, Artificial Sequence
  Synthetic oligonucleotide
aaaugacagacaagaauuuccuuggga

SEQ ID NO: 14410 - RNA, 27 nt, Artificial Sequence
  Synthetic oligonucleotide
aaugacagacaagaauuuccuugggag

SEQ ID NO: 14411 - RNA, 27 nt, Artificial Sequence
  Synthetic oligonucleotide
augacagacaagaauuuccuugggagg

SEQ ID NO: 14412 - RNA, 27 nt, Artificial Sequence
  Synthetic oligonucleotide
ugacagacaagaauuuccuugggaggc

SEQ ID NO: 14413 - RNA, 27 nt, Artificial Sequence
  Synthetic oligonucleotide
gacagacaagaauuuccuugggaggcc

SEQ ID NO: 14414 - RNA, 27 nt, Artificial Sequence
  Synthetic oligonucleotide
acagacaagaauuuccuugggaggcca

SEQ ID NO: 14415 - RNA, 27 nt, Artificial Sequence
  Synthetic oligonucleotide
cagacaagaauuuccuugggaggccag

SEQ ID NO: 14416 - RNA, 27 nt, Artificial Sequence
  Synthetic oligonucleotide
agacaagaauuuccuugggaggccagu

SEQ ID NO: 14417 - RNA, 27 nt, Artificial Sequence
  Synthetic oligonucleotide
gacaagaauuuccuugggaggccagua

SEQ ID NO: 14418 - RNA, 27 nt, Artificial Sequence
  Synthetic oligonucleotide
acaagaauuuccuugggaggccaguag

SEQ ID NO: 14419 - RNA, 27 nt, Artificial Sequence
  Synthetic oligonucleotide
caagaauuuccuugggaggccaguaga

SEQ ID NO: 14420 - RNA, 27 nt, Artificial Sequence
  Synthetic oligonucleotide
aagaauuuccuugggaggccaguagag

SEQ ID NO: 14421 - RNA, 27 nt, Artificial Sequence
  Synthetic oligonucleotide
uccuugggaggccaguagaggugcuuc

SEQ ID NO: 14422 - RNA, 27 nt, Artificial Sequence
  Synthetic oligonucleotide
uugggaggccaguagaggugcuucuca

SEQ ID NO: 14423 - RNA, 27 nt, Artificial Sequence
  Synthetic oligonucleotide
ugggaggccaguagaggugcuucucaa

SEQ ID NO: 14424 - RNA, 27 nt, Artificial Sequence
  Synthetic oligonucleotide
gggaggccaguagaggugcuucucaau

SEQ ID NO: 14425 - RNA, 27 nt, Artificial Sequence
  Synthetic oligonucleotide
ggaggccaguagaggugcuucucaaug

SEQ ID NO: 14426 - RNA, 27 nt, Artificial Sequence
  Synthetic oligonucleotide
gaggccaguagaggugcuucucaauga

SEQ ID NO: 14427 - RNA, 27 nt, Artificial Sequence
  Synthetic oligonucleotide
aggccaguagaggugcuucucaaugau

SEQ ID NO: 14428 - RNA, 27 nt, Artificial Sequence
  Synthetic oligonucleotide
ggccaguagaggugcuucucaaugaug

SEQ ID NO: 14429 - RNA, 27 nt, Artificial Sequence
  Synthetic oligonucleotide
gccaguagaggugcuucucaaugauga

SEQ ID NO: 14430 - RNA, 27 nt, Artificial Sequence
  Synthetic oligonucleotide
ccaguagaggugcuucucaaugaugac

SEQ ID NO: 14431 - RNA, 27 nt, Artificial Sequence
  Synthetic oligonucleotide
caguagaggugcuucucaaugaugacc

SEQ ID NO: 14432 - RNA, 27 nt, Artificial Sequence
  Synthetic oligonucleotide
aguagaggugcuucucaaugaugaccu

SEQ ID NO: 14433 - RNA, 27 nt, Artificial Sequence
  Synthetic oligonucleotide
guagaggugcuucucaaugaugaccuc

SEQ ID NO: 14434 - RNA, 27 nt, Artificial Sequence
  Synthetic oligonucleotide
uagaggugcuucucaaugaugaccuca

SEQ ID NO: 14435 - RNA, 27 nt, Artificial Sequence
  Synthetic oligonucleotide
agaggugcuucucaaugaugaccucau

SEQ ID NO: 14436 - RNA, 27 nt, Artificial Sequence
  Synthetic oligonucleotide
gaggugcuucucaaugaugaccucauu

SEQ ID NO: 14437 - RNA, 27 nt, Artificial Sequence
  Synthetic oligonucleotide
aggugcuucucaaugaugaccucauug

SEQ ID NO: 14438 - RNA, 27 nt, Artificial Sequence
  Synthetic oligonucleotide
ggugcuucucaaugaugaccucauugu

SEQ ID NO: 14439 - RNA, 27 nt, Artificial Sequence
  Synthetic oligonucleotide
gugcuucucaaugaugaccucauuguc

SEQ ID NO: 14440 - RNA, 27 nt, Artificial Sequence
  Synthetic oligonucleotide
cauugucaguacaggauuuggcagugg

SEQ ID NO: 14441 - RNA, 27 nt, Artificial Sequence
  Synthetic oligonucleotide
auugucaguacaggauuuggcaguggc

SEQ ID NO: 14442 - RNA, 27 nt, Artificial Sequence
  Synthetic oligonucleotide
uugucaguacaggauuuggcaguggcu

SEQ ID NO: 14443 - RNA, 27 nt, Artificial Sequence
  Synthetic oligonucleotide
ugucaguacaggauuuggcaguggcuu

SEQ ID NO: 14444 - RNA, 27 nt, Artificial Sequence
  Synthetic oligonucleotide
gucaguacaggauuuggcaguggcuug

SEQ ID NO: 14445 - RNA, 27 nt, Artificial Sequence
  Synthetic oligonucleotide
ucaguacaggauuuggcaguggcuugg

SEQ ID NO: 14446 - RNA, 27 nt, Artificial Sequence
  Synthetic oligonucleotide
caguacaggauuuggcaguggcuuggc

SEQ ID NO: 14447 - RNA, 27 nt, Artificial Sequence
  Synthetic oligonucleotide
aguacaggauuuggcaguggcuuggcu

SEQ ID NO: 14448 - RNA, 27 nt, Artificial Sequence
  Synthetic oligonucleotide
guacaggauuuggcaguggcuuggcua

SEQ ID NO: 14449 - RNA, 27 nt, Artificial Sequence
  Synthetic oligonucleotide
uacaggauuuggcaguggcuuggcuac

SEQ ID NO: 14450 - RNA, 27 nt, Artificial Sequence
  Synthetic oligonucleotide
acaggauuuggcaguggcuuggcuaca

SEQ ID NO: 14451 - RNA, 27 nt, Artificial Sequence
  Synthetic oligonucleotide
aggauuuggcaguggcuuggcuacagu

SEQ ID NO: 14452 - RNA, 27 nt, Artificial Sequence
  Synthetic oligonucleotide
ggauuuggcaguggcuuggcuacagua

SEQ ID NO: 14453 - RNA, 27 nt, Artificial Sequence
  Synthetic oligonucleotide
gauuuggcaguggcuuggcuacaguac

SEQ ID NO: 14454 - RNA, 27 nt, Artificial Sequence
  Synthetic oligonucleotide
auuuggcaguggcuuggcuacaguaca

SEQ ID NO: 14455 - RNA, 27 nt, Artificial Sequence
  Synthetic oligonucleotide
caguacauguaacaacuguaguucaca

SEQ ID NO: 14456 - RNA, 27 nt, Artificial Sequence
  Synthetic oligonucleotide
aguacauguaacaacuguaguucacaa

SEQ ID NO: 14457 - RNA, 27 nt, Artificial Sequence
  Synthetic oligonucleotide
guacauguaacaacuguaguucacaaa

SEQ ID NO: 14458 - RNA, 27 nt, Artificial Sequence
  Synthetic oligonucleotide
acauguaacaacuguaguucacaaaac

SEQ ID NO: 14459 - RNA, 27 nt, Artificial Sequence
  Synthetic oligonucleotide
cauguaacaacuguaguucacaaaacc

SEQ ID NO: 14460 - RNA, 27 nt, Artificial Sequence
  Synthetic oligonucleotide
auguaacaacuguaguucacaaaacca

SEQ ID NO: 14461 - RNA, 27 nt, Artificial Sequence
  Synthetic oligonucleotide
uguaacaacuguaguucacaaaaccag

SEQ ID NO: 14462 - RNA, 27 nt, Artificial Sequence
  Synthetic oligonucleotide
guaacaacuguaguucacaaaaccagu

SEQ ID NO: 14463 - RNA, 27 nt, Artificial Sequence
  Synthetic oligonucleotide
uaacaacuguaguucacaaaaccagua

SEQ ID NO: 14464 - RNA, 27 nt, Artificial Sequence
  Synthetic oligonucleotide
aacaacuguaguucacaaaaccaguac

SEQ ID NO: 14465 - RNA, 27 nt, Artificial Sequence
  Synthetic oligonucleotide
acaacuguaguucacaaaaccaguacc

SEQ ID NO: 14466 - RNA, 27 nt, Artificial Sequence
  Synthetic oligonucleotide
caacuguaguucacaaaaccaguaccu

SEQ ID NO: 14467 - RNA, 27 nt, Artificial Sequence
  Synthetic oligonucleotide
aacuguaguucacaaaaccaguaccuc

SEQ ID NO: 14468 - RNA, 27 nt, Artificial Sequence
  Synthetic oligonucleotide
acuguaguucacaaaaccaguaccucu

SEQ ID NO: 14469 - RNA, 27 nt, Artificial Sequence
  Synthetic oligonucleotide
cuguaguucacaaaaccaguaccucug

SEQ ID NO: 14470 - RNA, 27 nt, Artificial Sequence
  Synthetic oligonucleotide
uguaguucacaaaaccaguaccucuga

SEQ ID NO: 14471 - RNA, 27 nt, Artificial Sequence
  Synthetic oligonucleotide
guaguucacaaaaccaguaccucugag

SEQ ID NO: 14472 - RNA, 27 nt, Artificial Sequence
  Synthetic oligonucleotide
uaguucacaaaaccaguaccucugagg

SEQ ID NO: 14473 - RNA, 27 nt, Artificial Sequence
  Synthetic oligonucleotide
aguucacaaaaccaguaccucugagga

SEQ ID NO: 14474 - RNA, 27 nt, Artificial Sequence
  Synthetic oligonucleotide
guucacaaaaccaguaccucugaggaa

SEQ ID NO: 14475 - RNA, 27 nt, Artificial Sequence
  Synthetic oligonucleotide
uucacaaaaccaguaccucugaggaag

SEQ ID NO: 14476 - RNA, 27 nt, Artificial Sequence
  Synthetic oligonucleotide
ucacaaaaccaguaccucugaggaagu

SEQ ID NO: 14477 - RNA, 27 nt, Artificial Sequence
  Synthetic oligonucleotide
cacaaaaccaguaccucugaggaaguu

SEQ ID NO: 14478 - RNA, 27 nt, Artificial Sequence
  Synthetic oligonucleotide
acaaaaccaguaccucugaggaaguuu

SEQ ID NO: 14479 - RNA, 27 nt, Artificial Sequence
  Synthetic oligonucleotide
caaaaccaguaccucugaggaaguuug

SEQ ID NO: 14480 - RNA, 27 nt, Artificial Sequence
  Synthetic oligonucleotide
aaaaccaguaccucugaggaaguuugc

SEQ ID NO: 14481 - RNA, 27 nt, Artificial Sequence
  Synthetic oligonucleotide
aaaccaguaccucugaggaaguuugca

SEQ ID NO: 14482 - RNA, 27 nt, Artificial Sequence
  Synthetic oligonucleotide
aaccaguaccucugaggaaguuugcag

SEQ ID NO: 14483 - RNA, 27 nt, Artificial Sequence
  Synthetic oligonucleotide
accaguaccucugaggaaguuugcagc

SEQ ID NO: 14484 - RNA, 27 nt, Artificial Sequence
  Synthetic oligonucleotide
ccaguaccucugaggaaguuugcagcu

SEQ ID NO: 14485 - RNA, 27 nt, Artificial Sequence
  Synthetic oligonucleotide
caguaccucugaggaaguuugcagcuu

SEQ ID NO: 14486 - RNA, 27 nt, Artificial Sequence
  Synthetic oligonucleotide
aguaccucugaggaaguuugcagcuuu

SEQ ID NO: 14487 - RNA, 27 nt, Artificial Sequence
  Synthetic oligonucleotide
guaccucugaggaaguuugcagcuuuu

SEQ ID NO: 14488 - RNA, 27 nt, Artificial Sequence
  Synthetic oligonucleotide
uaccucugaggaaguuugcagcuuuua

SEQ ID NO: 14489 - RNA, 27 nt, Artificial Sequence
  Synthetic oligonucleotide
accucugaggaaguuugcagcuuuuau

SEQ ID NO: 14490 - RNA, 27 nt, Artificial Sequence
  Synthetic oligonucleotide
ccucugaggaaguuugcagcuuuuauu

SEQ ID NO: 14491 - RNA, 27 nt, Artificial Sequence
  Synthetic oligonucleotide
cucugaggaaguuugcagcuuuuauuu

SEQ ID NO: 14492 - RNA, 27 nt, Artificial Sequence
  Synthetic oligonucleotide
ucugaggaaguuugcagcuuuuauuug

SEQ ID NO: 14493 - RNA, 27 nt, Artificial Sequence
  Synthetic oligonucleotide
guuugcagcuuuuauuugaaaaucgau

SEQ ID NO: 14494 - RNA, 27 nt, Artificial Sequence
  Synthetic oligonucleotide
uuugcagcuuuuauuugaaaaucgaua

SEQ ID NO: 14495 - RNA, 27 nt, Artificial Sequence
  Synthetic oligonucleotide
ucgauacucaggauauugaagcauccc

SEQ ID NO: 14496 - RNA, 27 nt, Artificial Sequence
  Synthetic oligonucleotide
gauacucaggauauugaagcaucccac

SEQ ID NO: 14497 - RNA, 27 nt, Artificial Sequence
  Synthetic oligonucleotide
auacucaggauauugaagcaucccacu

SEQ ID NO: 14498 - RNA, 27 nt, Artificial Sequence
  Synthetic oligonucleotide
uacucaggauauugaagcaucccacua

SEQ ID NO: 14499 - RNA, 27 nt, Artificial Sequence
  Synthetic oligonucleotide
acucaggauauugaagcaucccacuac

SEQ ID NO: 14500 - RNA, 27 nt, Artificial Sequence
  Synthetic oligonucleotide
ucaggauauugaagcaucccacuacag

SEQ ID NO: 14501 - RNA, 27 nt, Artificial Sequence
  Synthetic oligonucleotide
caggauauugaagcaucccacuacaga

SEQ ID NO: 14502 - RNA, 27 nt, Artificial Sequence
  Synthetic oligonucleotide
aggauauugaagcaucccacuacagag

SEQ ID NO: 14503 - RNA, 27 nt, Artificial Sequence
  Synthetic oligonucleotide
ggauauugaagcaucccacuacagagg

SEQ ID NO: 14504 - RNA, 27 nt, Artificial Sequence
  Synthetic oligonucleotide
gauauugaagcaucccacuacagaggc

SEQ ID NO: 14505 - RNA, 27 nt, Artificial Sequence
  Synthetic oligonucleotide
auauugaagcaucccacuacagaggcu

SEQ ID NO: 14506 - RNA, 27 nt, Artificial Sequence
  Synthetic oligonucleotide
uauugaagcaucccacuacagaggcua

SEQ ID NO: 14507 - RNA, 27 nt, Artificial Sequence
  Synthetic oligonucleotide
auugaagcaucccacuacagaggcuac

SEQ ID NO: 14508 - RNA, 27 nt, Artificial Sequence
  Synthetic oligonucleotide
uugaagcaucccacuacagaggcuacg

SEQ ID NO: 14509 - RNA, 27 nt, Artificial Sequence
  Synthetic oligonucleotide
ugaagcaucccacuacagaggcuacgg

SEQ ID NO: 14510 - RNA, 27 nt, Artificial Sequence
  Synthetic oligonucleotide
gaagcaucccacuacagaggcuacgga

SEQ ID NO: 14511 - RNA, 27 nt, Artificial Sequence
  Synthetic oligonucleotide
aagcaucccacuacagaggcuacggaa

SEQ ID NO: 14512 - RNA, 27 nt, Artificial Sequence
  Synthetic oligonucleotide
agcaucccacuacagaggcuacggaaa

SEQ ID NO: 14513 - RNA, 27 nt, Artificial Sequence
  Synthetic oligonucleotide
gcaucccacuacagaggcuacggaaac

SEQ ID NO: 14514 - RNA, 27 nt, Artificial Sequence
  Synthetic oligonucleotide
caucccacuacagaggcuacggaaacu

SEQ ID NO: 14515 - RNA, 27 nt, Artificial Sequence
  Synthetic oligonucleotide
aucccacuacagaggcuacggaaacuc

SEQ ID NO: 14516 - RNA, 27 nt, Artificial Sequence
  Synthetic oligonucleotide
ucccacuacagaggcuacggaaacucu

SEQ ID NO: 14517 - RNA, 27 nt, Artificial Sequence
  Synthetic oligonucleotide
cccacuacagaggcuacggaaacucug

SEQ ID NO: 14518 - RNA, 27 nt, Artificial Sequence
  Synthetic oligonucleotide
ccacuacagaggcuacggaaacucuga

SEQ ID NO: 14519 - RNA, 27 nt, Artificial Sequence
  Synthetic oligonucleotide
cacuacagaggcuacggaaacucugau

SEQ ID NO: 14520 - RNA, 27 nt, Artificial Sequence
  Synthetic oligonucleotide
acuacagaggcuacggaaacucugauu

SEQ ID NO: 14521 - RNA, 27 nt, Artificial Sequence
  Synthetic oligonucleotide
cuacagaggcuacggaaacucugauua

SEQ ID NO: 14522 - RNA, 27 nt, Artificial Sequence
  Synthetic oligonucleotide
uacagaggcuacggaaacucugauuac

SEQ ID NO: 14523 - RNA, 27 nt, Artificial Sequence
  Synthetic oligonucleotide
acagaggcuacggaaacucugauuaca

SEQ ID NO: 14524 - RNA, 27 nt, Artificial Sequence
  Synthetic oligonucleotide
cagaggcuacggaaacucugauuacaa

SEQ ID NO: 14525 - RNA, 27 nt, Artificial Sequence
  Synthetic oligonucleotide
agaggcuacggaaacucugauuacaaa

SEQ ID NO: 14526 - RNA, 27 nt, Artificial Sequence
  Synthetic oligonucleotide
gaggcuacggaaacucugauuacaaac

SEQ ID NO: 14527 - RNA, 27 nt, Artificial Sequence
  Synthetic oligonucleotide
aggcuacggaaacucugauuacaaacg

SEQ ID NO: 14528 - RNA, 27 nt, Artificial Sequence
  Synthetic oligonucleotide
ggcuacggaaacucugauuacaaacgc

SEQ ID NO: 14529 - RNA, 27 nt, Artificial Sequence
  Synthetic oligonucleotide
gcuacggaaacucugauuacaaacgca

SEQ ID NO: 14530 - RNA, 27 nt, Artificial Sequence
  Synthetic oligonucleotide
cuacggaaacucugauuacaaacgcau

SEQ ID NO: 14531 - RNA, 27 nt, Artificial Sequence
  Synthetic oligonucleotide
uacggaaacucugauuacaaacgcaua

SEQ ID NO: 14532 - RNA, 27 nt, Artificial Sequence
  Synthetic oligonucleotide
acggaaacucugauuacaaacgcauag

SEQ ID NO: 14533 - RNA, 27 nt, Artificial Sequence
  Synthetic oligonucleotide
cggaaacucugauuacaaacgcauagu

SEQ ID NO: 14534 - RNA, 27 nt, Artificial Sequence
  Synthetic oligonucleotide
ggaaacucugauuacaaacgcauagua

SEQ ID NO: 14535 - RNA, 27 nt, Artificial Sequence
  Synthetic oligonucleotide
gaaacucugauuacaaacgcauaguag

SEQ ID NO: 14536 - RNA, 27 nt, Artificial Sequence
  Synthetic oligonucleotide
aaacucugauuacaaacgcauaguagc

SEQ ID NO: 14537 - RNA, 27 nt, Artificial Sequence
  Synthetic oligonucleotide
aacucugauuacaaacgcauaguagca

SEQ ID NO: 14538 - RNA, 27 nt, Artificial Sequence
  Synthetic oligonucleotide
acucugauuacaaacgcauaguagcau

SEQ ID NO: 14539 - RNA, 27 nt, Artificial Sequence
  Synthetic oligonucleotide
cucugauuacaaacgcauaguagcaug

SEQ ID NO: 14540 - RNA, 27 nt, Artificial Sequence
  Synthetic oligonucleotide
ucugauuacaaacgcauaguagcaugu

SEQ ID NO: 14541 - RNA, 27 nt, Artificial Sequence
  Synthetic oligonucleotide
cugauuacaaacgcauaguagcaugug

SEQ ID NO: 14542 - RNA, 27 nt, Artificial Sequence
  Synthetic oligonucleotide
ugauuacaaacgcauaguagcaugugc

SEQ ID NO: 14543 - RNA, 27 nt, Artificial Sequence
  Synthetic oligonucleotide
gauuacaaacgcauaguagcaugugcc

SEQ ID NO: 14544 - RNA, 27 nt, Artificial Sequence
  Synthetic oligonucleotide
auuacaaacgcauaguagcaugugcca

SEQ ID NO: 14545 - RNA, 27 nt, Artificial Sequence
  Synthetic oligonucleotide
uuacaaacgcauaguagcaugugccag

SEQ ID NO: 14546 - RNA, 27 nt, Artificial Sequence
  Synthetic oligonucleotide
uacaaacgcauaguagcaugugccagc

SEQ ID NO: 14547 - RNA, 27 nt, Artificial Sequence
  Synthetic oligonucleotide
acaaacgcauaguagcaugugccagcu

SEQ ID NO: 14548 - RNA, 27 nt, Artificial Sequence
  Synthetic oligonucleotide
caaacgcauaguagcaugugccagcua

SEQ ID NO: 14549 - RNA, 27 nt, Artificial Sequence
  Synthetic oligonucleotide
aaacgcauaguagcaugugccagcuac

SEQ ID NO: 14550 - RNA, 27 nt, Artificial Sequence
  Synthetic oligonucleotide
aacgcauaguagcaugugccagcuaca

SEQ ID NO: 14551 - RNA, 27 nt, Artificial Sequence
  Synthetic oligonucleotide
acgcauaguagcaugugccagcuacaa

SEQ ID NO: 14552 - RNA, 27 nt, Artificial Sequence
  Synthetic oligonucleotide
cgcauaguagcaugugccagcuacaag

SEQ ID NO: 14553 - RNA, 27 nt, Artificial Sequence
  Synthetic oligonucleotide
gcauaguagcaugugccagcuacaagc

SEQ ID NO: 14554 - RNA, 27 nt, Artificial Sequence
  Synthetic oligonucleotide
cauaguagcaugugccagcuacaagcc

SEQ ID NO: 14555 - RNA, 27 nt, Artificial Sequence
  Synthetic oligonucleotide
auaguagcaugugccagcuacaagccc

SEQ ID NO: 14556 - RNA, 27 nt, Artificial Sequence
  Synthetic oligonucleotide
uaguagcaugugccagcuacaagccca

SEQ ID NO: 14557 - RNA, 27 nt, Artificial Sequence
  Synthetic oligonucleotide
cggugauggacaucuccuugccuacug

SEQ ID NO: 14558 - RNA, 27 nt, Artificial Sequence
  Synthetic oligonucleotide
ggugauggacaucuccuugccuacugg

SEQ ID NO: 14559 - RNA, 27 nt, Artificial Sequence
  Synthetic oligonucleotide
gugauggacaucuccuugccuacugga

SEQ ID NO: 14560 - RNA, 27 nt, Artificial Sequence
  Synthetic oligonucleotide
ugauggacaucuccuugccuacuggaa

SEQ ID NO: 14561 - RNA, 27 nt, Artificial Sequence
  Synthetic oligonucleotide
gauggacaucuccuugccuacuggaau

SEQ ID NO: 14562 - RNA, 27 nt, Artificial Sequence
  Synthetic oligonucleotide
auggacaucuccuugccuacuggaauc

SEQ ID NO: 14563 - RNA, 27 nt, Artificial Sequence
  Synthetic oligonucleotide
uggacaucuccuugccuacuggaauca

SEQ ID NO: 14564 - RNA, 27 nt, Artificial Sequence
  Synthetic oligonucleotide
ggacaucuccuugccuacuggaaucag

SEQ ID NO: 14565 - RNA, 27 nt, Artificial Sequence
  Synthetic oligonucleotide
gacaucuccuugccuacuggaaucagu

SEQ ID NO: 14566 - RNA, 27 nt, Artificial Sequence
  Synthetic oligonucleotide
acaucuccuugccuacuggaaucagug

SEQ ID NO: 14567 - RNA, 27 nt, Artificial Sequence
  Synthetic oligonucleotide
caucuccuugccuacuggaaucagugc

SEQ ID NO: 14568 - RNA, 27 nt, Artificial Sequence
  Synthetic oligonucleotide
aucuccuugccuacuggaaucagugca

SEQ ID NO: 14569 - RNA, 27 nt, Artificial Sequence
  Synthetic oligonucleotide
ucuccuugccuacuggaaucagugcaa

SEQ ID NO: 14570 - RNA, 27 nt, Artificial Sequence
  Synthetic oligonucleotide
agugcaaaugaagaagacuuaaaagcc

SEQ ID NO: 14571 - RNA, 27 nt, Artificial Sequence
  Synthetic oligonucleotide
gugcaaaugaagaagacuuaaaagccc

SEQ ID NO: 14572 - RNA, 27 nt, Artificial Sequence
  Synthetic oligonucleotide
ugcaaaugaagaagacuuaaaagcccu

SEQ ID NO: 14573 - RNA, 27 nt, Artificial Sequence
  Synthetic oligonucleotide
gcaaaugaagaagacuuaaaagcccuu

SEQ ID NO: 14574 - RNA, 27 nt, Artificial Sequence
  Synthetic oligonucleotide
caaaugaagaagacuuaaaagcccuug

SEQ ID NO: 14575 - RNA, 27 nt, Artificial Sequence
  Synthetic oligonucleotide
aaaugaagaagacuuaaaagcccuugu

SEQ ID NO: 14576 - RNA, 27 nt, Artificial Sequence
  Synthetic oligonucleotide
cccuuguggaagggguggaucaacuau

SEQ ID NO: 14577 - RNA, 27 nt, Artificial Sequence
  Synthetic oligonucleotide
ccuuguggaagggguggaucaacuauu

SEQ ID NO: 14578 - RNA, 27 nt, Artificial Sequence
  Synthetic oligonucleotide
aacuauucacugauuaccaaaucaaag

SEQ ID NO: 14579 - RNA, 27 nt, Artificial Sequence
  Synthetic oligonucleotide
acuauucacugauuaccaaaucaaaga

SEQ ID NO: 14580 - RNA, 27 nt, Artificial Sequence
  Synthetic oligonucleotide
ucaaagauggacauguuauucugcaac

SEQ ID NO: 14581 - RNA, 27 nt, Artificial Sequence
  Synthetic oligonucleotide
caaagauggacauguuauucugcaacu

SEQ ID NO: 14582 - RNA, 27 nt, Artificial Sequence
  Synthetic oligonucleotide
aaagauggacauguuauucugcaacug

SEQ ID NO: 14583 - RNA, 27 nt, Artificial Sequence
  Synthetic oligonucleotide
gauggacauguuauucugcaacugaau

SEQ ID NO: 14584 - RNA, 27 nt, Artificial Sequence
  Synthetic oligonucleotide
uggacauguuauucugcaacugaauuc

SEQ ID NO: 14585 - RNA, 27 nt, Artificial Sequence
  Synthetic oligonucleotide
cauguuauucugcaacugaauucgauu

SEQ ID NO: 14586 - RNA, 27 nt, Artificial Sequence
  Synthetic oligonucleotide
auguuauucugcaacugaauucgauuc

SEQ ID NO: 14587 - RNA, 27 nt, Artificial Sequence
  Synthetic oligonucleotide
uguuauucugcaacugaauucgauucc

SEQ ID NO: 14588 - RNA, 27 nt, Artificial Sequence
  Synthetic oligonucleotide
guuauucugcaacugaauucgauuccc

SEQ ID NO: 14589 - RNA, 27 nt, Artificial Sequence
  Synthetic oligonucleotide
uauuugaacucuuugaaguuggguuuc

SEQ ID NO: 14590 - RNA, 27 nt, Artificial Sequence
  Synthetic oligonucleotide
auuugaacucuuugaaguuggguuucu

SEQ ID NO: 14591 - RNA, 27 nt, Artificial Sequence
  Synthetic oligonucleotide
uuugaacucuuugaaguuggguuucuc

SEQ ID NO: 14592 - RNA, 27 nt, Artificial Sequence
  Synthetic oligonucleotide
uugaacucuuugaaguuggguuucuca

SEQ ID NO: 14593 - RNA, 27 nt, Artificial Sequence
  Synthetic oligonucleotide
ugaacucuuugaaguuggguuucucag

SEQ ID NO: 14594 - RNA, 27 nt, Artificial Sequence
  Synthetic oligonucleotide
gaacucuuugaaguuggguuucucagu

SEQ ID NO: 14595 - RNA, 27 nt, Artificial Sequence
  Synthetic oligonucleotide
aacucuuugaaguuggguuucucaguc

SEQ ID NO: 14596 - RNA, 27 nt, Artificial Sequence
  Synthetic oligonucleotide
acucuuugaaguuggguuucucagucc

SEQ ID NO: 14597 - RNA, 27 nt, Artificial Sequence
  Synthetic oligonucleotide
ucaguccugccacuuucacaguguacg

SEQ ID NO: 14598 - RNA, 27 nt, Artificial Sequence
  Synthetic oligonucleotide
caguccugccacuuucacaguguacga

SEQ ID NO: 14599 - RNA, 27 nt, Artificial Sequence
  Synthetic oligonucleotide
aguccugccacuuucacaguguacgaa

SEQ ID NO: 14600 - RNA, 27 nt, Artificial Sequence
  Synthetic oligonucleotide
guccugccacuuucacaguguacgaau

SEQ ID NO: 14601 - RNA, 27 nt, Artificial Sequence
  Synthetic oligonucleotide
uccugccacuuucacaguguacgaaua

SEQ ID NO: 14602 - RNA, 27 nt, Artificial Sequence
  Synthetic oligonucleotide
acgaauaccacagaccagauaaacagu

SEQ ID NO: 14603 - RNA, 27 nt, Artificial Sequence
  Synthetic oligonucleotide
cgaauaccacagaccagauaaacagug

SEQ ID NO: 14604 - RNA, 27 nt, Artificial Sequence
  Synthetic oligonucleotide
gaauaccacagaccagauaaacagugu

SEQ ID NO: 14605 - RNA, 27 nt, Artificial Sequence
  Synthetic oligonucleotide
aauaccacagaccagauaaacagugua

SEQ ID NO: 14606 - RNA, 27 nt, Artificial Sequence
  Synthetic oligonucleotide
auaccacagaccagauaaacaguguac

SEQ ID NO: 14607 - RNA, 27 nt, Artificial Sequence
  Synthetic oligonucleotide
uaccacagaccagauaaacaguguacc

SEQ ID NO: 14608 - RNA, 27 nt, Artificial Sequence
  Synthetic oligonucleotide
accacagaccagauaaacaguguacca

SEQ ID NO: 14609 - RNA, 27 nt, Artificial Sequence
  Synthetic oligonucleotide
ccacagaccagauaaacaguguaccau

SEQ ID NO: 14610 - RNA, 27 nt, Artificial Sequence
  Synthetic oligonucleotide
cacagaccagauaaacaguguaccaug

SEQ ID NO: 14611 - RNA, 27 nt, Artificial Sequence
  Synthetic oligonucleotide
acagaccagauaaacaguguaccaugu

SEQ ID NO: 14612 - RNA, 27 nt, Artificial Sequence
  Synthetic oligonucleotide
cagaccagauaaacaguguaccauguu

SEQ ID NO: 14613 - RNA, 27 nt, Artificial Sequence
  Synthetic oligonucleotide
agaccagauaaacaguguaccauguuu

SEQ ID NO: 14614 - RNA, 27 nt, Artificial Sequence
  Synthetic oligonucleotide
gaccagauaaacaguguaccauguuuu

SEQ ID NO: 14615 - RNA, 27 nt, Artificial Sequence
  Synthetic oligonucleotide
accagauaaacaguguaccauguuuua

SEQ ID NO: 14616 - RNA, 27 nt, Artificial Sequence
  Synthetic oligonucleotide
ccagauaaacaguguaccauguuuuau

SEQ ID NO: 14617 - RNA, 27 nt, Artificial Sequence
  Synthetic oligonucleotide
gauaaacaguguaccauguuuuauagc

SEQ ID NO: 14618 - RNA, 27 nt, Artificial Sequence
  Synthetic oligonucleotide
uaaacaguguaccauguuuuauagcac

SEQ ID NO: 14619 - RNA, 27 nt, Artificial Sequence
  Synthetic oligonucleotide
aacaguguaccauguuuuauagcacuu

SEQ ID NO: 14620 - RNA, 27 nt, Artificial Sequence
  Synthetic oligonucleotide
acaguguaccauguuuuauagcacuuc

SEQ ID NO: 14621 - RNA, 27 nt, Artificial Sequence
  Synthetic oligonucleotide
caguguaccauguuuuauagcacuucc

SEQ ID NO: 14622 - RNA, 27 nt, Artificial Sequence
  Synthetic oligonucleotide
aguguaccauguuuuauagcacuucca

SEQ ID NO: 14623 - RNA, 27 nt, Artificial Sequence
  Synthetic oligonucleotide
guguaccauguuuuauagcacuuccaa

SEQ ID NO: 14624 - RNA, 27 nt, Artificial Sequence
  Synthetic oligonucleotide
uguaccauguuuuauagcacuuccaau

SEQ ID NO: 14625 - RNA, 27 nt, Artificial Sequence
  Synthetic oligonucleotide
guaccauguuuuauagcacuuccaaua

SEQ ID NO: 14626 - RNA, 27 nt, Artificial Sequence
  Synthetic oligonucleotide
uaccauguuuuauagcacuuccaauau

SEQ ID NO: 14627 - RNA, 27 nt, Artificial Sequence
  Synthetic oligonucleotide
accauguuuuauagcacuuccaauauc

SEQ ID NO: 14628 - RNA, 27 nt, Artificial Sequence
  Synthetic oligonucleotide
ccauguuuuauagcacuuccaauauca

SEQ ID NO: 14629 - RNA, 27 nt, Artificial Sequence
  Synthetic oligonucleotide
cauguuuuauagcacuuccaauaucaa

SEQ ID NO: 14630 - RNA, 27 nt, Artificial Sequence
  Synthetic oligonucleotide
auguuuuauagcacuuccaauaucaaa

SEQ ID NO: 14631 - RNA, 27 nt, Artificial Sequence
  Synthetic oligonucleotide
uguuuuauagcacuuccaauaucaaaa

SEQ ID NO: 14632 - RNA, 27 nt, Artificial Sequence
  Synthetic oligonucleotide
guuuuauagcacuuccaauaucaaaau

SEQ ID NO: 14633 - RNA, 27 nt, Artificial Sequence
  Synthetic oligonucleotide
uuuuauagcacuuccaauaucaaaauu

SEQ ID NO: 14634 - RNA, 27 nt, Artificial Sequence
  Synthetic oligonucleotide
uuuauagcacuuccaauaucaaaauuc

SEQ ID NO: 14635 - RNA, 27 nt, Artificial Sequence
  Synthetic oligonucleotide
uauagcacuuccaauaucaaaauucag

SEQ ID NO: 14636 - RNA, 27 nt, Artificial Sequence
  Synthetic oligonucleotide
auagcacuuccaauaucaaaauucaga

SEQ ID NO: 14637 - RNA, 27 nt, Artificial Sequence
  Synthetic oligonucleotide
uagcacuuccaauaucaaaauucagaa

SEQ ID NO: 14638 - RNA, 27 nt, Artificial Sequence
  Synthetic oligonucleotide
agcacuuccaauaucaaaauucagaaa

SEQ ID NO: 14639 - RNA, 27 nt, Artificial Sequence
  Synthetic oligonucleotide
gcacuuccaauaucaaaauucagaaag

SEQ ID NO: 14640 - RNA, 27 nt, Artificial Sequence
  Synthetic oligonucleotide
cacuuccaauaucaaaauucagaaagu

SEQ ID NO: 14641 - RNA, 27 nt, Artificial Sequence
  Synthetic oligonucleotide
acuuccaauaucaaaauucagaaaguc

SEQ ID NO: 14642 - RNA, 27 nt, Artificial Sequence
  Synthetic oligonucleotide
cuuccaauaucaaaauucagaaagucu

SEQ ID NO: 14643 - RNA, 27 nt, Artificial Sequence
  Synthetic oligonucleotide
uuccaauaucaaaauucagaaagucug

SEQ ID NO: 14644 - RNA, 27 nt, Artificial Sequence
  Synthetic oligonucleotide
uccaauaucaaaauucagaaagucugu

SEQ ID NO: 14645 - RNA, 27 nt, Artificial Sequence
  Synthetic oligonucleotide
ccaauaucaaaauucagaaagucugug

SEQ ID NO: 14646 - RNA, 27 nt, Artificial Sequence
  Synthetic oligonucleotide
caauaucaaaauucagaaagucuguga

SEQ ID NO: 14647 - RNA, 27 nt, Artificial Sequence
  Synthetic oligonucleotide
aauaucaaaauucagaaagucugugaa

SEQ ID NO: 14648 - RNA, 27 nt, Artificial Sequence
  Synthetic oligonucleotide
auaucaaaauucagaaagucugugaag

SEQ ID NO: 14649 - RNA, 27 nt, Artificial Sequence
  Synthetic oligonucleotide
uaucaaaauucagaaagucugugaagg

SEQ ID NO: 14650 - RNA, 27 nt, Artificial Sequence
  Synthetic oligonucleotide
aucaaaauucagaaagucugugaagga

SEQ ID NO: 14651 - RNA, 27 nt, Artificial Sequence
  Synthetic oligonucleotide
ucaaaauucagaaagucugugaaggag

SEQ ID NO: 14652 - RNA, 27 nt, Artificial Sequence
  Synthetic oligonucleotide
caaaauucagaaagucugugaaggagc

SEQ ID NO: 14653 - RNA, 27 nt, Artificial Sequence
  Synthetic oligonucleotide
aaaauucagaaagucugugaaggagcc

SEQ ID NO: 14654 - RNA, 27 nt, Artificial Sequence
  Synthetic oligonucleotide
aaauucagaaagucugugaaggagccg

SEQ ID NO: 14655 - RNA, 27 nt, Artificial Sequence
  Synthetic oligonucleotide
cagaaagucugugaaggagccgcgugc

SEQ ID NO: 14656 - RNA, 27 nt, Artificial Sequence
  Synthetic oligonucleotide
uguagaagcugauugugggcaaaugca

SEQ ID NO: 14657 - RNA, 27 nt, Artificial Sequence
  Synthetic oligonucleotide
guagaagcugauugugggcaaaugcag

SEQ ID NO: 14658 - RNA, 27 nt, Artificial Sequence
  Synthetic oligonucleotide
uagaagcugauugugggcaaaugcagg

SEQ ID NO: 14659 - RNA, 27 nt, Artificial Sequence
  Synthetic oligonucleotide
agaagcugauugugggcaaaugcagga

SEQ ID NO: 14660 - RNA, 27 nt, Artificial Sequence
  Synthetic oligonucleotide
gaagcugauugugggcaaaugcaggaa

SEQ ID NO: 14661 - RNA, 27 nt, Artificial Sequence
  Synthetic oligonucleotide
aagcugauugugggcaaaugcaggaag

SEQ ID NO: 14662 - RNA, 27 nt, Artificial Sequence
  Synthetic oligonucleotide
agcugauugugggcaaaugcaggaaga

SEQ ID NO: 14663 - RNA, 27 nt, Artificial Sequence
  Synthetic oligonucleotide
gcugauugugggcaaaugcaggaagaa

SEQ ID NO: 14664 - RNA, 27 nt, Artificial Sequence
  Synthetic oligonucleotide
ggaagaauuggaucugacaaucucugc

SEQ ID NO: 14665 - RNA, 27 nt, Artificial Sequence
  Synthetic oligonucleotide
gaagaauuggaucugacaaucucugca

SEQ ID NO: 14666 - RNA, 27 nt, Artificial Sequence
  Synthetic oligonucleotide
aagaauuggaucugacaaucucugcag

SEQ ID NO: 14667 - RNA, 27 nt, Artificial Sequence
  Synthetic oligonucleotide
agaauuggaucugacaaucucugcaga

SEQ ID NO: 14668 - RNA, 27 nt, Artificial Sequence
  Synthetic oligonucleotide
gaauuggaucugacaaucucugcagag

SEQ ID NO: 14669 - RNA, 27 nt, Artificial Sequence
  Synthetic oligonucleotide
aauuggaucugacaaucucugcagaga

SEQ ID NO: 14670 - RNA, 27 nt, Artificial Sequence
  Synthetic oligonucleotide
auuggaucugacaaucucugcagagac

SEQ ID NO: 14671 - RNA, 27 nt, Artificial Sequence
  Synthetic oligonucleotide
uuggaucugacaaucucugcagagaca

SEQ ID NO: 14672 - RNA, 27 nt, Artificial Sequence
  Synthetic oligonucleotide
uggaucugacaaucucugcagagacaa

SEQ ID NO: 14673 - RNA, 27 nt, Artificial Sequence
  Synthetic oligonucleotide
ggaucugacaaucucugcagagacaag

SEQ ID NO: 14674 - RNA, 27 nt, Artificial Sequence
  Synthetic oligonucleotide
gaucugacaaucucugcagagacaaga

SEQ ID NO: 14675 - RNA, 27 nt, Artificial Sequence
  Synthetic oligonucleotide
aucugacaaucucugcagagacaagaa

SEQ ID NO: 14676 - RNA, 27 nt, Artificial Sequence
  Synthetic oligonucleotide
ucugacaaucucugcagagacaagaaa

SEQ ID NO: 14677 - RNA, 27 nt, Artificial Sequence
  Synthetic oligonucleotide
caagaaaacaaacagcauguaaaccag

SEQ ID NO: 14678 - RNA, 27 nt, Artificial Sequence
  Synthetic oligonucleotide
aagaaaacaaacagcauguaaaccaga

SEQ ID NO: 14679 - RNA, 27 nt, Artificial Sequence
  Synthetic oligonucleotide
gagauugcauaugcuuauaaaguuagc

SEQ ID NO: 14680 - RNA, 27 nt, Artificial Sequence
  Synthetic oligonucleotide
agauugcauaugcuuauaaaguuagca

SEQ ID NO: 14681 - RNA, 27 nt, Artificial Sequence
  Synthetic oligonucleotide
gauugcauaugcuuauaaaguuagcau

SEQ ID NO: 14682 - RNA, 27 nt, Artificial Sequence
  Synthetic oligonucleotide
auugcauaugcuuauaaaguuagcauc

SEQ ID NO: 14683 - RNA, 27 nt, Artificial Sequence
  Synthetic oligonucleotide
uugcauaugcuuauaaaguuagcauca

SEQ ID NO: 14684 - RNA, 27 nt, Artificial Sequence
  Synthetic oligonucleotide
aaauguuuuugucaaguacaaggcaac

SEQ ID NO: 14685 - RNA, 27 nt, Artificial Sequence
  Synthetic oligonucleotide
aauguuuuugucaaguacaaggcaacc

SEQ ID NO: 14686 - RNA, 27 nt, Artificial Sequence
  Synthetic oligonucleotide
auguuuuugucaaguacaaggcaaccc

SEQ ID NO: 14687 - RNA, 27 nt, Artificial Sequence
  Synthetic oligonucleotide
uguuuuugucaaguacaaggcaacccu

SEQ ID NO: 14688 - RNA, 27 nt, Artificial Sequence
  Synthetic oligonucleotide
guuuuugucaaguacaaggcaacccuu

SEQ ID NO: 14689 - RNA, 27 nt, Artificial Sequence
  Synthetic oligonucleotide
uuuuugucaaguacaaggcaacccuuc

SEQ ID NO: 14690 - RNA, 27 nt, Artificial Sequence
  Synthetic oligonucleotide
uuuugucaaguacaaggcaacccuucu

SEQ ID NO: 14691 - RNA, 27 nt, Artificial Sequence
  Synthetic oligonucleotide
uuugucaaguacaaggcaacccuucug

SEQ ID NO: 14692 - RNA, 27 nt, Artificial Sequence
  Synthetic oligonucleotide
uugucaaguacaaggcaacccuucugg

SEQ ID NO: 14693 - RNA, 27 nt, Artificial Sequence
  Synthetic oligonucleotide
ugucaaguacaaggcaacccuucugga

SEQ ID NO: 14694 - RNA, 27 nt, Artificial Sequence
  Synthetic oligonucleotide
gucaaguacaaggcaacccuucuggau

SEQ ID NO: 14695 - RNA, 27 nt, Artificial Sequence
  Synthetic oligonucleotide
ucaaguacaaggcaacccuucuggaua

SEQ ID NO: 14696 - RNA, 27 nt, Artificial Sequence
  Synthetic oligonucleotide
caaguacaaggcaacccuucuggauau

SEQ ID NO: 14697 - RNA, 27 nt, Artificial Sequence
  Synthetic oligonucleotide
aaguacaaggcaacccuucuggauauc

SEQ ID NO: 14698 - RNA, 27 nt, Artificial Sequence
  Synthetic oligonucleotide
aguacaaggcaacccuucuggauaucu

SEQ ID NO: 14699 - RNA, 27 nt, Artificial Sequence
  Synthetic oligonucleotide
guacaaggcaacccuucuggauaucua

SEQ ID NO: 14700 - RNA, 27 nt, Artificial Sequence
  Synthetic oligonucleotide
uacaaggcaacccuucuggauaucuac

SEQ ID NO: 14701 - RNA, 27 nt, Artificial Sequence
  Synthetic oligonucleotide
acaaggcaacccuucuggauaucuaca

SEQ ID NO: 14702 - RNA, 27 nt, Artificial Sequence
  Synthetic oligonucleotide
caaggcaacccuucuggauaucuacaa

SEQ ID NO: 14703 - RNA, 27 nt, Artificial Sequence
  Synthetic oligonucleotide
aaggcaacccuucuggauaucuacaaa

SEQ ID NO: 14704 - RNA, 27 nt, Artificial Sequence
  Synthetic oligonucleotide
aggcaacccuucuggauaucuacaaaa

SEQ ID NO: 14705 - RNA, 27 nt, Artificial Sequence
  Synthetic oligonucleotide
ggcaacccuucuggauaucuacaaaac

SEQ ID NO: 14706 - RNA, 27 nt, Artificial Sequence
  Synthetic oligonucleotide
gcaacccuucuggauaucuacaaaacu

SEQ ID NO: 14707 - RNA, 27 nt, Artificial Sequence
  Synthetic oligonucleotide
caacccuucuggauaucuacaaaacug

SEQ ID NO: 14708 - RNA, 27 nt, Artificial Sequence
  Synthetic oligonucleotide
aacccuucuggauaucuacaaaacugg

SEQ ID NO: 14709 - RNA, 27 nt, Artificial Sequence
  Synthetic oligonucleotide
acccuucuggauaucuacaaaacuggg

SEQ ID NO: 14710 - RNA, 27 nt, Artificial Sequence
  Synthetic oligonucleotide
cccuucuggauaucuacaaaacugggg

SEQ ID NO: 14711 - RNA, 27 nt, Artificial Sequence
  Synthetic oligonucleotide
ccuucuggauaucuacaaaacugggga

SEQ ID NO: 14712 - RNA, 27 nt, Artificial Sequence
  Synthetic oligonucleotide
cuucuggauaucuacaaaacuggggaa

SEQ ID NO: 14713 - RNA, 27 nt, Artificial Sequence
  Synthetic oligonucleotide
uucuggauaucuacaaaacuggggaag

SEQ ID NO: 14714 - RNA, 27 nt, Artificial Sequence
  Synthetic oligonucleotide
ucuggauaucuacaaaacuggggaagc

SEQ ID NO: 14715 - RNA, 27 nt, Artificial Sequence
  Synthetic oligonucleotide
cuggauaucuacaaaacuggggaagcu

SEQ ID NO: 14716 - RNA, 27 nt, Artificial Sequence
  Synthetic oligonucleotide
uggauaucuacaaaacuggggaagcug

SEQ ID NO: 14717 - RNA, 27 nt, Artificial Sequence
  Synthetic oligonucleotide
ggauaucuacaaaacuggggaagcugu

SEQ ID NO: 14718 - RNA, 27 nt, Artificial Sequence
  Synthetic oligonucleotide
gauaucuacaaaacuggggaagcuguu

SEQ ID NO: 14719 - RNA, 27 nt, Artificial Sequence
  Synthetic oligonucleotide
auaucuacaaaacuggggaagcuguug

SEQ ID NO: 14720 - RNA, 27 nt, Artificial Sequence
  Synthetic oligonucleotide
uaucuacaaaacuggggaagcuguugc

SEQ ID NO: 14721 - RNA, 27 nt, Artificial Sequence
  Synthetic oligonucleotide
aucuacaaaacuggggaagcuguugcu

SEQ ID NO: 14722 - RNA, 27 nt, Artificial Sequence
  Synthetic oligonucleotide
ucuacaaaacuggggaagcuguugcug

SEQ ID NO: 14723 - RNA, 27 nt, Artificial Sequence
  Synthetic oligonucleotide
cuacaaaacuggggaagcuguugcuga

SEQ ID NO: 14724 - RNA, 27 nt, Artificial Sequence
  Synthetic oligonucleotide
uacaaaacuggggaagcuguugcugag

SEQ ID NO: 14725 - RNA, 27 nt, Artificial Sequence
  Synthetic oligonucleotide
acaaaacuggggaagcuguugcugaga

SEQ ID NO: 14726 - RNA, 27 nt, Artificial Sequence
  Synthetic oligonucleotide
caaaacuggggaagcuguugcugagaa

SEQ ID NO: 14727 - RNA, 27 nt, Artificial Sequence
  Synthetic oligonucleotide
aaaacuggggaagcuguugcugagaaa

SEQ ID NO: 14728 - RNA, 27 nt, Artificial Sequence
  Synthetic oligonucleotide
aaacuggggaagcuguugcugagaaag

SEQ ID NO: 14729 - RNA, 27 nt, Artificial Sequence
  Synthetic oligonucleotide
aacuggggaagcuguugcugagaaaga

SEQ ID NO: 14730 - RNA, 27 nt, Artificial Sequence
  Synthetic oligonucleotide
uuaccuucauuaaaaagguaaccugua

SEQ ID NO: 14731 - RNA, 27 nt, Artificial Sequence
  Synthetic oligonucleotide
uaccuucauuaaaaagguaaccuguac

SEQ ID NO: 14732 - RNA, 27 nt, Artificial Sequence
  Synthetic oligonucleotide
accuucauuaaaaagguaaccuguacu

SEQ ID NO: 14733 - RNA, 27 nt, Artificial Sequence
  Synthetic oligonucleotide
ccuucauuaaaaagguaaccuguacua

SEQ ID NO: 14734 - RNA, 27 nt, Artificial Sequence
  Synthetic oligonucleotide
cuucauuaaaaagguaaccuguacuaa

SEQ ID NO: 14735 - RNA, 27 nt, Artificial Sequence
  Synthetic oligonucleotide
uaaaaggaagacaguacuuaauuaugg

SEQ ID NO: 14736 - RNA, 27 nt, Artificial Sequence
  Synthetic oligonucleotide
aaaaggaagacaguacuuaauuauggg

SEQ ID NO: 14737 - RNA, 27 nt, Artificial Sequence
  Synthetic oligonucleotide
aaaggaagacaguacuuaauuaugggu

SEQ ID NO: 14738 - RNA, 27 nt, Artificial Sequence
  Synthetic oligonucleotide
aaggaagacaguacuuaauuaugggua

SEQ ID NO: 14739 - RNA, 27 nt, Artificial Sequence
  Synthetic oligonucleotide
aggaagacaguacuuaauuauggguaa

SEQ ID NO: 14740 - RNA, 27 nt, Artificial Sequence
  Synthetic oligonucleotide
ggaagacaguacuuaauuauggguaaa

SEQ ID NO: 14741 - RNA, 27 nt, Artificial Sequence
  Synthetic oligonucleotide
gaagacaguacuuaauuauggguaaag

SEQ ID NO: 14742 - RNA, 27 nt, Artificial Sequence
  Synthetic oligonucleotide
aagacaguacuuaauuauggguaaaga

SEQ ID NO: 14743 - RNA, 27 nt, Artificial Sequence
  Synthetic oligonucleotide
cccuccagauaaaauacaauuucaguu

SEQ ID NO: 14744 - RNA, 27 nt, Artificial Sequence
  Synthetic oligonucleotide
ccuccagauaaaauacaauuucaguuu

SEQ ID NO: 14745 - RNA, 27 nt, Artificial Sequence
  Synthetic oligonucleotide
uccagauaaaauacaauuucaguuuca

SEQ ID NO: 14746 - RNA, 27 nt, Artificial Sequence
  Synthetic oligonucleotide
aguuucagguacaucuacccuuuagau

SEQ ID NO: 14747 - RNA, 27 nt, Artificial Sequence
  Synthetic oligonucleotide
guuucagguacaucuacccuuuagauu

SEQ ID NO: 14748 - RNA, 27 nt, Artificial Sequence
  Synthetic oligonucleotide
uuucagguacaucuacccuuuagauuc

SEQ ID NO: 14749 - RNA, 27 nt, Artificial Sequence
  Synthetic oligonucleotide
uucagguacaucuacccuuuagauucc

SEQ ID NO: 14750 - RNA, 27 nt, Artificial Sequence
  Synthetic oligonucleotide
ucagguacaucuacccuuuagauuccu

SEQ ID NO: 14751 - RNA, 27 nt, Artificial Sequence
  Synthetic oligonucleotide
cagguacaucuacccuuuagauuccuu

SEQ ID NO: 14752 - RNA, 27 nt, Artificial Sequence
  Synthetic oligonucleotide
agguacaucuacccuuuagauuccuug

SEQ ID NO: 14753 - RNA, 27 nt, Artificial Sequence
  Synthetic oligonucleotide
gguacaucuacccuuuagauuccuuga

SEQ ID NO: 14754 - RNA, 27 nt, Artificial Sequence
  Synthetic oligonucleotide
guacaucuacccuuuagauuccuugac

SEQ ID NO: 14755 - RNA, 27 nt, Artificial Sequence
  Synthetic oligonucleotide
uacaucuacccuuuagauuccuugacc

SEQ ID NO: 14756 - RNA, 27 nt, Artificial Sequence
  Synthetic oligonucleotide
acaucuacccuuuagauuccuugaccu

SEQ ID NO: 14757 - RNA, 27 nt, Artificial Sequence
  Synthetic oligonucleotide
caucuacccuuuagauuccuugaccug

SEQ ID NO: 14758 - RNA, 27 nt, Artificial Sequence
  Synthetic oligonucleotide
aucuacccuuuagauuccuugaccugg

SEQ ID NO: 14759 - RNA, 27 nt, Artificial Sequence
  Synthetic oligonucleotide
ucuacccuuuagauuccuugaccugga

SEQ ID NO: 14760 - RNA, 27 nt, Artificial Sequence
  Synthetic oligonucleotide
cuacccuuuagauuccuugaccuggau

SEQ ID NO: 14761 - RNA, 27 nt, Artificial Sequence
  Synthetic oligonucleotide
uacccuuuagauuccuugaccuggauu

SEQ ID NO: 14762 - RNA, 27 nt, Artificial Sequence
  Synthetic oligonucleotide
acccuuuagauuccuugaccuggauug

SEQ ID NO: 14763 - RNA, 27 nt, Artificial Sequence
  Synthetic oligonucleotide
cccuuuagauuccuugaccuggauuga

SEQ ID NO: 14764 - RNA, 27 nt, Artificial Sequence
  Synthetic oligonucleotide
ccuuuagauuccuugaccuggauugaa

SEQ ID NO: 14765 - RNA, 27 nt, Artificial Sequence
  Synthetic oligonucleotide
cuuuagauuccuugaccuggauugaau

SEQ ID NO: 14766 - RNA, 27 nt, Artificial Sequence
  Synthetic oligonucleotide
uuuagauuccuugaccuggauugaaua

SEQ ID NO: 14767 - RNA, 27 nt, Artificial Sequence
  Synthetic oligonucleotide
uuagauuccuugaccuggauugaauac

SEQ ID NO: 14768 - RNA, 27 nt, Artificial Sequence
  Synthetic oligonucleotide
uagauuccuugaccuggauugaauacu

SEQ ID NO: 14769 - RNA, 27 nt, Artificial Sequence
  Synthetic oligonucleotide
agauuccuugaccuggauugaauacug

SEQ ID NO: 14770 - RNA, 27 nt, Artificial Sequence
  Synthetic oligonucleotide
gauuccuugaccuggauugaauacugg

SEQ ID NO: 14771 - RNA, 27 nt, Artificial Sequence
  Synthetic oligonucleotide
auuccuugaccuggauugaauacuggc

SEQ ID NO: 14772 - RNA, 27 nt, Artificial Sequence
  Synthetic oligonucleotide
uuccuugaccuggauugaauacuggcc

SEQ ID NO: 14773 - RNA, 27 nt, Artificial Sequence
  Synthetic oligonucleotide
uccuugaccuggauugaauacuggccu

SEQ ID NO: 14774 - RNA, 27 nt, Artificial Sequence
  Synthetic oligonucleotide
ccuugaccuggauugaauacuggccua

SEQ ID NO: 14775 - RNA, 27 nt, Artificial Sequence
  Synthetic oligonucleotide
cuugaccuggauugaauacuggccuag

SEQ ID NO: 14776 - RNA, 27 nt, Artificial Sequence
  Synthetic oligonucleotide
uugaccuggauugaauacuggccuaga

SEQ ID NO: 14777 - RNA, 27 nt, Artificial Sequence
  Synthetic oligonucleotide
ugaccuggauugaauacuggccuagag

SEQ ID NO: 14778 - RNA, 27 nt, Artificial Sequence
  Synthetic oligonucleotide
gaccuggauugaauacuggccuagaga

SEQ ID NO: 14779 - RNA, 27 nt, Artificial Sequence
  Synthetic oligonucleotide
accuggauugaauacuggccuagagac

SEQ ID NO: 14780 - RNA, 27 nt, Artificial Sequence
  Synthetic oligonucleotide
ccuggauugaauacuggccuagagaca

SEQ ID NO: 14781 - RNA, 27 nt, Artificial Sequence
  Synthetic oligonucleotide
cuggauugaauacuggccuagagacac

SEQ ID NO: 14782 - RNA, 27 nt, Artificial Sequence
  Synthetic oligonucleotide
cacaacauguucaucgugucaagcauu

SEQ ID NO: 14783 - RNA, 27 nt, Artificial Sequence
  Synthetic oligonucleotide
acaacauguucaucgugucaagcauuu

SEQ ID NO: 14784 - RNA, 27 nt, Artificial Sequence
  Synthetic oligonucleotide
caacauguucaucgugucaagcauuuu

SEQ ID NO: 14785 - RNA, 27 nt, Artificial Sequence
  Synthetic oligonucleotide
aacauguucaucgugucaagcauuuuu

SEQ ID NO: 14786 - RNA, 27 nt, Artificial Sequence
  Synthetic oligonucleotide
cauguucaucgugucaagcauuuuuag

SEQ ID NO: 14787 - RNA, 27 nt, Artificial Sequence
  Synthetic oligonucleotide
auguucaucgugucaagcauuuuuagc

SEQ ID NO: 14788 - RNA, 27 nt, Artificial Sequence
  Synthetic oligonucleotide
uguucaucgugucaagcauuuuuagcu

SEQ ID NO: 14789 - RNA, 27 nt, Artificial Sequence
  Synthetic oligonucleotide
guucaucgugucaagcauuuuuagcua

SEQ ID NO: 14790 - RNA, 27 nt, Artificial Sequence
  Synthetic oligonucleotide
ucaucgugucaagcauuuuuagcuaau

SEQ ID NO: 14791 - RNA, 27 nt, Artificial Sequence
  Synthetic oligonucleotide
caucgugucaagcauuuuuagcuaauu

SEQ ID NO: 14792 - RNA, 27 nt, Artificial Sequence
  Synthetic oligonucleotide
aucgugucaagcauuuuuagcuaauuu

SEQ ID NO: 14793 - RNA, 27 nt, Artificial Sequence
  Synthetic oligonucleotide
cgugucaagcauuuuuagcuaauuuag

SEQ ID NO: 14794 - RNA, 27 nt, Artificial Sequence
  Synthetic oligonucleotide
gugucaagcauuuuuagcuaauuuaga

SEQ ID NO: 14795 - RNA, 27 nt, Artificial Sequence
  Synthetic oligonucleotide
ugucaagcauuuuuagcuaauuuagau

SEQ ID NO: 14796 - RNA, 27 nt, Artificial Sequence
  Synthetic oligonucleotide
gucaagcauuuuuagcuaauuuagaug

SEQ ID NO: 14797 - RNA, 27 nt, Artificial Sequence
  Synthetic oligonucleotide
caagcauuuuuagcuaauuuagaugaa

SEQ ID NO: 14798 - RNA, 27 nt, Artificial Sequence
  Synthetic oligonucleotide
aagcauuuuuagcuaauuuagaugaau

SEQ ID NO: 14799 - RNA, 27 nt, Artificial Sequence
  Synthetic oligonucleotide
agcauuuuuagcuaauuuagaugaauu

SEQ ID NO: 14800 - RNA, 27 nt, Artificial Sequence
  Synthetic oligonucleotide
gcauuuuuagcuaauuuagaugaauuu

SEQ ID NO: 14801 - RNA, 27 nt, Artificial Sequence
  Synthetic oligonucleotide
cauuuuuagcuaauuuagaugaauuug

SEQ ID NO: 14802 - RNA, 27 nt, Artificial Sequence
  Synthetic oligonucleotide
auuuuuagcuaauuuagaugaauuugc

SEQ ID NO: 14803 - RNA, 27 nt, Artificial Sequence
  Synthetic oligonucleotide
uuuuuagcuaauuuagaugaauuugcc

SEQ ID NO: 14804 - RNA, 27 nt, Artificial Sequence
  Synthetic oligonucleotide
uuuuagcuaauuuagaugaauuugccg

SEQ ID NO: 14805 - RNA, 27 nt, Artificial Sequence
  Synthetic oligonucleotide
uuuagcuaauuuagaugaauuugccga

SEQ ID NO: 14806 - RNA, 27 nt, Artificial Sequence
  Synthetic oligonucleotide
uuagcuaauuuagaugaauuugccgaa

SEQ ID NO: 14807 - RNA, 27 nt, Artificial Sequence
  Synthetic oligonucleotide
uagcuaauuuagaugaauuugccgaag

SEQ ID NO: 14808 - RNA, 27 nt, Artificial Sequence
  Synthetic oligonucleotide
agcuaauuuagaugaauuugccgaaga

SEQ ID NO: 14809 - RNA, 27 nt, Artificial Sequence
  Synthetic oligonucleotide
auaucuuuuuaaauggaugcuaaaauu

SEQ ID NO: 14810 - RNA, 27 nt, Artificial Sequence
  Synthetic oligonucleotide
uaucuuuuuaaauggaugcuaaaauuc

SEQ ID NO: 14811 - RNA, 27 nt, Artificial Sequence
  Synthetic oligonucleotide
aucuuuuuaaauggaugcuaaaauucc

SEQ ID NO: 14812 - RNA, 27 nt, Artificial Sequence
  Synthetic oligonucleotide
ucuuuuuaaauggaugcuaaaauuccu

SEQ ID NO: 14813 - RNA, 27 nt, Artificial Sequence
  Synthetic oligonucleotide
cuuuuuaaauggaugcuaaaauuccug

SEQ ID NO: 14814 - RNA, 27 nt, Artificial Sequence
  Synthetic oligonucleotide
uuuuuaaauggaugcuaaaauuccuga

SEQ ID NO: 14815 - RNA, 27 nt, Artificial Sequence
  Synthetic oligonucleotide
uuuuaaauggaugcuaaaauuccugaa

SEQ ID NO: 14816 - RNA, 27 nt, Artificial Sequence
  Synthetic oligonucleotide
uuuaaauggaugcuaaaauuccugaag

SEQ ID NO: 14817 - RNA, 27 nt, Artificial Sequence
  Synthetic oligonucleotide
uuaaauggaugcuaaaauuccugaagu

SEQ ID NO: 14818 - RNA, 27 nt, Artificial Sequence
  Synthetic oligonucleotide
uaaauggaugcuaaaauuccugaaguu

SEQ ID NO: 14819 - RNA, 27 nt, Artificial Sequence
  Synthetic oligonucleotide
aaauggaugcuaaaauuccugaaguuc

SEQ ID NO: 14820 - RNA, 27 nt, Artificial Sequence
  Synthetic oligonucleotide
auggaugcuaaaauuccugaaguucag

SEQ ID NO: 14821 - RNA, 27 nt, Artificial Sequence
  Synthetic oligonucleotide
uggaugcuaaaauuccugaaguucagc

SEQ ID NO: 14822 - RNA, 27 nt, Artificial Sequence
  Synthetic oligonucleotide
ggaugcuaaaauuccugaaguucagcu

SEQ ID NO: 14823 - RNA, 27 nt, Artificial Sequence
  Synthetic oligonucleotide
gaugcuaaaauuccugaaguucagcug

SEQ ID NO: 14824 - RNA, 27 nt, Artificial Sequence
  Synthetic oligonucleotide
augcuaaaauuccugaaguucagcugc

SEQ ID NO: 14825 - RNA, 27 nt, Artificial Sequence
  Synthetic oligonucleotide
ugcuaaaauuccugaaguucagcugca

SEQ ID NO: 14826 - RNA, 27 nt, Artificial Sequence
  Synthetic oligonucleotide
gcuaaaauuccugaaguucagcugcau

SEQ ID NO: 14827 - RNA, 27 nt, Artificial Sequence
  Synthetic oligonucleotide
cuaaaauuccugaaguucagcugcaua

SEQ ID NO: 14828 - RNA, 27 nt, Artificial Sequence
  Synthetic oligonucleotide
uaaaauuccugaaguucagcugcauac

SEQ ID NO: 14829 - RNA, 27 nt, Artificial Sequence
  Synthetic oligonucleotide
aaaauuccugaaguucagcugcauaca

SEQ ID NO: 14830 - RNA, 27 nt, Artificial Sequence
  Synthetic oligonucleotide
aaauuccugaaguucagcugcauacag

SEQ ID NO: 14831 - RNA, 27 nt, Artificial Sequence
  Synthetic oligonucleotide
aauuccugaaguucagcugcauacagu

SEQ ID NO: 14832 - RNA, 27 nt, Artificial Sequence
  Synthetic oligonucleotide
auuccugaaguucagcugcauacaguu

SEQ ID NO: 14833 - RNA, 27 nt, Artificial Sequence
  Synthetic oligonucleotide
uuccugaaguucagcugcauacaguuu

SEQ ID NO: 14834 - RNA, 27 nt, Artificial Sequence
  Synthetic oligonucleotide
uccugaaguucagcugcauacaguuug

SEQ ID NO: 14835 - RNA, 27 nt, Artificial Sequence
  Synthetic oligonucleotide
ccugaaguucagcugcauacaguuugc

SEQ ID NO: 14836 - RNA, 27 nt, Artificial Sequence
  Synthetic oligonucleotide
cugaaguucagcugcauacaguuugca

SEQ ID NO: 14837 - RNA, 27 nt, Artificial Sequence
  Synthetic oligonucleotide
ugaaguucagcugcauacaguuugcac

SEQ ID NO: 14838 - RNA, 27 nt, Artificial Sequence
  Synthetic oligonucleotide
gaaguucagcugcauacaguuugcacu

SEQ ID NO: 14839 - RNA, 27 nt, Artificial Sequence
  Synthetic oligonucleotide
aaguucagcugcauacaguuugcacuu

SEQ ID NO: 14840 - RNA, 27 nt, Artificial Sequence
  Synthetic oligonucleotide
aguucagcugcauacaguuugcacuua

SEQ ID NO: 14841 - RNA, 27 nt, Artificial Sequence
  Synthetic oligonucleotide
guucagcugcauacaguuugcacuuau

SEQ ID NO: 14842 - RNA, 27 nt, Artificial Sequence
  Synthetic oligonucleotide
uucagcugcauacaguuugcacuuaug

SEQ ID NO: 14843 - RNA, 27 nt, Artificial Sequence
  Synthetic oligonucleotide
ucagcugcauacaguuugcacuuaugg

SEQ ID NO: 14844 - RNA, 27 nt, Artificial Sequence
  Synthetic oligonucleotide
cagcugcauacaguuugcacuuaugga

SEQ ID NO: 14845 - RNA, 27 nt, Artificial Sequence
  Synthetic oligonucleotide
agcugcauacaguuugcacuuauggac

SEQ ID NO: 14846 - RNA, 27 nt, Artificial Sequence
  Synthetic oligonucleotide
gcugcauacaguuugcacuuauggacu

SEQ ID NO: 14847 - RNA, 27 nt, Artificial Sequence
  Synthetic oligonucleotide
cugcauacaguuugcacuuauggacuc

SEQ ID NO: 14848 - RNA, 27 nt, Artificial Sequence
  Synthetic oligonucleotide
ugcauacaguuugcacuuauggacucc

SEQ ID NO: 14849 - RNA, 27 nt, Artificial Sequence
  Synthetic oligonucleotide
gcauacaguuugcacuuauggacuccu

SEQ ID NO: 14850 - RNA, 27 nt, Artificial Sequence
  Synthetic oligonucleotide
cauacaguuugcacuuauggacuccug

SEQ ID NO: 14851 - RNA, 27 nt, Artificial Sequence
  Synthetic oligonucleotide
auacaguuugcacuuauggacuccugu

SEQ ID NO: 14852 - RNA, 27 nt, Artificial Sequence
  Synthetic oligonucleotide
uacaguuugcacuuauggacuccuguu

SEQ ID NO: 14853 - RNA, 27 nt, Artificial Sequence
  Synthetic oligonucleotide
acaguuugcacuuauggacuccuguug

SEQ ID NO: 14854 - RNA, 27 nt, Artificial Sequence
  Synthetic oligonucleotide
caguuugcacuuauggacuccuguugu

SEQ ID NO: 14855 - RNA, 27 nt, Artificial Sequence
  Synthetic oligonucleotide
aguuugcacuuauggacuccuguuguu

SEQ ID NO: 14856 - RNA, 27 nt, Artificial Sequence
  Synthetic oligonucleotide
guuugcacuuauggacuccuguuguug

SEQ ID NO: 14857 - RNA, 27 nt, Artificial Sequence
  Synthetic oligonucleotide
uuugcacuuauggacuccuguuguuga

SEQ ID NO: 14858 - RNA, 27 nt, Artificial Sequence
  Synthetic oligonucleotide
uugcacuuauggacuccuguuguugaa

SEQ ID NO: 14859 - RNA, 27 nt, Artificial Sequence
  Synthetic oligonucleotide
ugcacuuauggacuccuguuguugaag

SEQ ID NO: 14860 - RNA, 27 nt, Artificial Sequence
  Synthetic oligonucleotide
gcacuuauggacuccuguuguugaagu

SEQ ID NO: 14861 - RNA, 27 nt, Artificial Sequence
  Synthetic oligonucleotide
cacuuauggacuccuguuguugaaguu

SEQ ID NO: 14862 - RNA, 27 nt, Artificial Sequence
  Synthetic oligonucleotide
acuuauggacuccuguuguugaaguuc

SEQ ID NO: 14863 - RNA, 27 nt, Artificial Sequence
  Synthetic oligonucleotide
cuuauggacuccuguuguugaaguucg

SEQ ID NO: 14864 - RNA, 27 nt, Artificial Sequence
  Synthetic oligonucleotide
uauggacuccuguuguugaaguucguu

SEQ ID NO: 14865 - RNA, 27 nt, Artificial Sequence
  Synthetic oligonucleotide
auagcuggucuuauuuguaaagcucac

SEQ ID NO: 14866 - RNA, 27 nt, Artificial Sequence
  Synthetic oligonucleotide
uagcuggucuuauuuguaaagcucacu

SEQ ID NO: 14867 - RNA, 27 nt, Artificial Sequence
  Synthetic oligonucleotide
agcuggucuuauuuguaaagcucacuu

SEQ ID NO: 14868 - RNA, 27 nt, Artificial Sequence
  Synthetic oligonucleotide
gcuggucuuauuuguaaagcucacuuu

SEQ ID NO: 14869 - RNA, 27 nt, Artificial Sequence
  Synthetic oligonucleotide
cuggucuuauuuguaaagcucacuuua

SEQ ID NO: 14870 - RNA, 27 nt, Artificial Sequence
  Synthetic oligonucleotide
uggucuuauuuguaaagcucacuuuac

SEQ ID NO: 14871 - RNA, 27 nt, Artificial Sequence
  Synthetic oligonucleotide
ggucuuauuuguaaagcucacuuuacu

SEQ ID NO: 14872 - RNA, 27 nt, Artificial Sequence
  Synthetic oligonucleotide
gucuuauuuguaaagcucacuuuacuu

SEQ ID NO: 14873 - RNA, 27 nt, Artificial Sequence
  Synthetic oligonucleotide
ucuuauuuguaaagcucacuuuacuua

SEQ ID NO: 14874 - RNA, 27 nt, Artificial Sequence
  Synthetic oligonucleotide
cuuauuuguaaagcucacuuuacuuag

SEQ ID NO: 14875 - RNA, 27 nt, Artificial Sequence
  Synthetic oligonucleotide
uuauuuguaaagcucacuuuacuuaga

SEQ ID NO: 14876 - RNA, 27 nt, Artificial Sequence
  Synthetic oligonucleotide
uauuuguaaagcucacuuuacuuagaa

SEQ ID NO: 14877 - RNA, 27 nt, Artificial Sequence
  Synthetic oligonucleotide
auuuguaaagcucacuuuacuuagaau

SEQ ID NO: 14878 - RNA, 27 nt, Artificial Sequence
  Synthetic oligonucleotide
uuuguaaagcucacuuuacuuagaauu

SEQ ID NO: 14879 - RNA, 27 nt, Artificial Sequence
  Synthetic oligonucleotide
uuguaaagcucacuuuacuuagaauua

SEQ ID NO: 14880 - RNA, 27 nt, Artificial Sequence
  Synthetic oligonucleotide
uguaaagcucacuuuacuuagaauuag

SEQ ID NO: 14881 - RNA, 27 nt, Artificial Sequence
  Synthetic oligonucleotide
guaaagcucacuuuacuuagaauuagu

SEQ ID NO: 14882 - RNA, 27 nt, Artificial Sequence
  Synthetic oligonucleotide
uaaagcucacuuuacuuagaauuagug

SEQ ID NO: 14883 - RNA, 27 nt, Artificial Sequence
  Synthetic oligonucleotide
aaagcucacuuuacuuagaauuagugg

SEQ ID NO: 14884 - RNA, 27 nt, Artificial Sequence
  Synthetic oligonucleotide
aagcucacuuuacuuagaauuaguggc

SEQ ID NO: 14885 - RNA, 27 nt, Artificial Sequence
  Synthetic oligonucleotide
agcucacuuuacuuagaauuaguggca

SEQ ID NO: 14886 - RNA, 27 nt, Artificial Sequence
  Synthetic oligonucleotide
gcucacuuuacuuagaauuaguggcac

SEQ ID NO: 14887 - RNA, 27 nt, Artificial Sequence
  Synthetic oligonucleotide
cucacuuuacuuagaauuaguggcacu

SEQ ID NO: 14888 - RNA, 27 nt, Artificial Sequence
  Synthetic oligonucleotide
ucacuuuacuuagaauuaguggcacuu

SEQ ID NO: 14889 - RNA, 27 nt, Artificial Sequence
  Synthetic oligonucleotide
cacuuuacuuagaauuaguggcacuug

SEQ ID NO: 14890 - RNA, 27 nt, Artificial Sequence
  Synthetic oligonucleotide
acuuuacuuagaauuaguggcacuugc

SEQ ID NO: 14891 - RNA, 27 nt, Artificial Sequence
  Synthetic oligonucleotide
cuuuacuuagaauuaguggcacuugcu

SEQ ID NO: 14892 - RNA, 27 nt, Artificial Sequence
  Synthetic oligonucleotide
uuuacuuagaauuaguggcacuugcuu

SEQ ID NO: 14893 - RNA, 27 nt, Artificial Sequence
  Synthetic oligonucleotide
uuacuuagaauuaguggcacuugcuuu

SEQ ID NO: 14894 - RNA, 27 nt, Artificial Sequence
  Synthetic oligonucleotide
uacuuagaauuaguggcacuugcuuuu

SEQ ID NO: 14895 - RNA, 27 nt, Artificial Sequence
  Synthetic oligonucleotide
acuuagaauuaguggcacuugcuuuua

SEQ ID NO: 14896 - RNA, 27 nt, Artificial Sequence
  Synthetic oligonucleotide
cuuagaauuaguggcacuugcuuuuau

SEQ ID NO: 14897 - RNA, 27 nt, Artificial Sequence
  Synthetic oligonucleotide
uuagaauuaguggcacuugcuuuuauu

SEQ ID NO: 14898 - RNA, 27 nt, Artificial Sequence
  Synthetic oligonucleotide
uagaauuaguggcacuugcuuuuauua

SEQ ID NO: 14899 - RNA, 27 nt, Artificial Sequence
  Synthetic oligonucleotide
agaauuaguggcacuugcuuuuauuag

SEQ ID NO: 14900 - RNA, 27 nt, Artificial Sequence
  Synthetic oligonucleotide
gaauuaguggcacuugcuuuuauuaga

SEQ ID NO: 14901 - RNA, 27 nt, Artificial Sequence
  Synthetic oligonucleotide
aauuaguggcacuugcuuuuauuagag

SEQ ID NO: 14902 - RNA, 27 nt, Artificial Sequence
  Synthetic oligonucleotide
auuaguggcacuugcuuuuauuagaga

SEQ ID NO: 14903 - RNA, 27 nt, Artificial Sequence
  Synthetic oligonucleotide
uuaguggcacuugcuuuuauuagagaa

SEQ ID NO: 14904 - RNA, 27 nt, Artificial Sequence
  Synthetic oligonucleotide
uaguggcacuugcuuuuauuagagaau

SEQ ID NO: 14905 - RNA, 27 nt, Artificial Sequence
  Synthetic oligonucleotide
aguggcacuugcuuuuauuagagaaug

SEQ ID NO: 14906 - RNA, 27 nt, Artificial Sequence
  Synthetic oligonucleotide
guggcacuugcuuuuauuagagaauga

SEQ ID NO: 14907 - RNA, 27 nt, Artificial Sequence
  Synthetic oligonucleotide
uggcacuugcuuuuauuagagaaugau

SEQ ID NO: 14908 - RNA, 27 nt, Artificial Sequence
  Synthetic oligonucleotide
ggcacuugcuuuuauuagagaaugauu

SEQ ID NO: 14909 - RNA, 27 nt, Artificial Sequence
  Synthetic oligonucleotide
gcacuugcuuuuauuagagaaugauuu

SEQ ID NO: 14910 - RNA, 27 nt, Artificial Sequence
  Synthetic oligonucleotide
cacuugcuuuuauuagagaaugauuuc

SEQ ID NO: 14911 - RNA, 27 nt, Artificial Sequence
  Synthetic oligonucleotide
gcuuuuauuagagaaugauuucaaaug

SEQ ID NO: 14912 - RNA, 27 nt, Artificial Sequence
  Synthetic oligonucleotide
augcuguaacuuucugaaauaacaugg

SEQ ID NO: 14913 - RNA, 27 nt, Artificial Sequence
  Synthetic oligonucleotide
ugcuguaacuuucugaaauaacauggc

SEQ ID NO: 14914 - RNA, 27 nt, Artificial Sequence
  Synthetic oligonucleotide
gcuguaacuuucugaaauaacauggcc

SEQ ID NO: 14915 - RNA, 27 nt, Artificial Sequence
  Synthetic oligonucleotide
cuguaacuuucugaaauaacauggccu

SEQ ID NO: 14916 - RNA, 27 nt, Artificial Sequence
  Synthetic oligonucleotide
uguaacuuucugaaauaacauggccuu

SEQ ID NO: 14917 - RNA, 27 nt, Artificial Sequence
  Synthetic oligonucleotide
guaacuuucugaaauaacauggccuug

SEQ ID NO: 14918 - RNA, 27 nt, Artificial Sequence
  Synthetic oligonucleotide
uaacuuucugaaauaacauggccuugg

SEQ ID NO: 14919 - RNA, 27 nt, Artificial Sequence
  Synthetic oligonucleotide
aacuuucugaaauaacauggccuugga

SEQ ID NO: 14920 - RNA, 27 nt, Artificial Sequence
  Synthetic oligonucleotide
acuuucugaaauaacauggccuuggag

SEQ ID NO: 14921 - RNA, 27 nt, Artificial Sequence
  Synthetic oligonucleotide
cuuucugaaauaacauggccuuggagg

SEQ ID NO: 14922 - RNA, 27 nt, Artificial Sequence
  Synthetic oligonucleotide
uuucugaaauaacauggccuuggaggg

SEQ ID NO: 14923 - RNA, 27 nt, Artificial Sequence
  Synthetic oligonucleotide
uucugaaauaacauggccuuggagggc

SEQ ID NO: 14924 - RNA, 27 nt, Artificial Sequence
  Synthetic oligonucleotide
ucugaaauaacauggccuuggagggca

SEQ ID NO: 14925 - RNA, 27 nt, Artificial Sequence
  Synthetic oligonucleotide
cugaaauaacauggccuuggagggcau

SEQ ID NO: 14926 - RNA, 27 nt, Artificial Sequence
  Synthetic oligonucleotide
ugaaauaacauggccuuggagggcaug

SEQ ID NO: 14927 - RNA, 27 nt, Artificial Sequence
  Synthetic oligonucleotide
gaaauaacauggccuuggagggcauga

SEQ ID NO: 14928 - RNA, 27 nt, Artificial Sequence
  Synthetic oligonucleotide
aaauaacauggccuuggagggcaugaa

SEQ ID NO: 14929 - RNA, 27 nt, Artificial Sequence
  Synthetic oligonucleotide
aauaacauggccuuggagggcaugaag

SEQ ID NO: 14930 - RNA, 27 nt, Artificial Sequence
  Synthetic oligonucleotide
auaacauggccuuggagggcaugaaga

SEQ ID NO: 14931 - RNA, 27 nt, Artificial Sequence
  Synthetic oligonucleotide
uaacauggccuuggagggcaugaagac

SEQ ID NO: 14932 - RNA, 27 nt, Artificial Sequence
  Synthetic oligonucleotide
aacauggccuuggagggcaugaagaca

SEQ ID NO: 14933 - RNA, 27 nt, Artificial Sequence
  Synthetic oligonucleotide
acauggccuuggagggcaugaagacag

SEQ ID NO: 14934 - RNA, 27 nt, Artificial Sequence
  Synthetic oligonucleotide
cauggccuuggagggcaugaagacaga

SEQ ID NO: 14935 - RNA, 27 nt, Artificial Sequence
  Synthetic oligonucleotide
auggccuuggagggcaugaagacagau

SEQ ID NO: 14936 - RNA, 27 nt, Artificial Sequence
  Synthetic oligonucleotide
uggccuuggagggcaugaagacagaua

SEQ ID NO: 14937 - RNA, 27 nt, Artificial Sequence
  Synthetic oligonucleotide
ggccuuggagggcaugaagacagauac

SEQ ID NO: 14938 - RNA, 27 nt, Artificial Sequence
  Synthetic oligonucleotide
gccuuggagggcaugaagacagauacu

SEQ ID NO: 14939 - RNA, 27 nt, Artificial Sequence
  Synthetic oligonucleotide
ccuuggagggcaugaagacagauacuc

SEQ ID NO: 14940 - RNA, 27 nt, Artificial Sequence
  Synthetic oligonucleotide
cuuggagggcaugaagacagauacucc

SEQ ID NO: 14941 - RNA, 27 nt, Artificial Sequence
  Synthetic oligonucleotide
uuggagggcaugaagacagauacuccu

SEQ ID NO: 14942 - RNA, 27 nt, Artificial Sequence
  Synthetic oligonucleotide
uggagggcaugaagacagauacuccuc

SEQ ID NO: 14943 - RNA, 27 nt, Artificial Sequence
  Synthetic oligonucleotide
ggagggcaugaagacagauacuccucc

SEQ ID NO: 14944 - RNA, 27 nt, Artificial Sequence
  Synthetic oligonucleotide
gagggcaugaagacagauacuccucca

SEQ ID NO: 14945 - RNA, 27 nt, Artificial Sequence
  Synthetic oligonucleotide
agggcaugaagacagauacuccuccaa

SEQ ID NO: 14946 - RNA, 27 nt, Artificial Sequence
  Synthetic oligonucleotide
gggcaugaagacagauacuccuccaag

SEQ ID NO: 14947 - RNA, 27 nt, Artificial Sequence
  Synthetic oligonucleotide
ggcaugaagacagauacuccuccaagg

SEQ ID NO: 14948 - RNA, 27 nt, Artificial Sequence
  Synthetic oligonucleotide
gcaugaagacagauacuccuccaaggu

SEQ ID NO: 14949 - RNA, 27 nt, Artificial Sequence
  Synthetic oligonucleotide
caugaagacagauacuccuccaagguu

SEQ ID NO: 14950 - RNA, 27 nt, Artificial Sequence
  Synthetic oligonucleotide
augaagacagauacuccuccaagguua

SEQ ID NO: 14951 - RNA, 27 nt, Artificial Sequence
  Synthetic oligonucleotide
ugaagacagauacuccuccaagguuau

SEQ ID NO: 14952 - RNA, 27 nt, Artificial Sequence
  Synthetic oligonucleotide
gaagacagauacuccuccaagguuauu

SEQ ID NO: 14953 - RNA, 27 nt, Artificial Sequence
  Synthetic oligonucleotide
aagacagauacuccuccaagguuauug

SEQ ID NO: 14954 - RNA, 27 nt, Artificial Sequence
  Synthetic oligonucleotide
agacagauacuccuccaagguuauugg

SEQ ID NO: 14955 - RNA, 27 nt, Artificial Sequence
  Synthetic oligonucleotide
acagauacuccuccaagguuauuggac

SEQ ID NO: 14956 - RNA, 27 nt, Artificial Sequence
  Synthetic oligonucleotide
cagauacuccuccaagguuauuggaca

SEQ ID NO: 14957 - RNA, 27 nt, Artificial Sequence
  Synthetic oligonucleotide
agauacuccuccaagguuauuggacac

SEQ ID NO: 14958 - RNA, 27 nt, Artificial Sequence
  Synthetic oligonucleotide
gauacuccuccaagguuauuggacacc

SEQ ID NO: 14959 - RNA, 27 nt, Artificial Sequence
  Synthetic oligonucleotide
auacuccuccaagguuauuggacaccg

SEQ ID NO: 14960 - RNA, 27 nt, Artificial Sequence
  Synthetic oligonucleotide
uacuccuccaagguuauuggacaccgg

SEQ ID NO: 14961 - RNA, 27 nt, Artificial Sequence
  Synthetic oligonucleotide
acuccuccaagguuauuggacaccgga

SEQ ID NO: 14962 - RNA, 27 nt, Artificial Sequence
  Synthetic oligonucleotide
cuccuccaagguuauuggacaccggaa

SEQ ID NO: 14963 - RNA, 27 nt, Artificial Sequence
  Synthetic oligonucleotide
uccuccaagguuauuggacaccggaaa

SEQ ID NO: 14964 - RNA, 27 nt, Artificial Sequence
  Synthetic oligonucleotide
ccuccaagguuauuggacaccggaaac

SEQ ID NO: 14965 - RNA, 27 nt, Artificial Sequence
  Synthetic oligonucleotide
cuccaagguuauuggacaccggaaaca

SEQ ID NO: 14966 - RNA, 27 nt, Artificial Sequence
  Synthetic oligonucleotide
uccaagguuauuggacaccggaaacaa

SEQ ID NO: 14967 - RNA, 27 nt, Artificial Sequence
  Synthetic oligonucleotide
ccaagguuauuggacaccggaaacaau

SEQ ID NO: 14968 - RNA, 27 nt, Artificial Sequence
  Synthetic oligonucleotide
caagguuauuggacaccggaaacaaua

SEQ ID NO: 14969 - RNA, 27 nt, Artificial Sequence
  Synthetic oligonucleotide
aagguuauuggacaccggaaacaauaa

SEQ ID NO: 14970 - RNA, 27 nt, Artificial Sequence
  Synthetic oligonucleotide
agguuauuggacaccggaaacaauaaa

SEQ ID NO: 14971 - RNA, 27 nt, Artificial Sequence
  Synthetic oligonucleotide
gguuauuggacaccggaaacaauaaau

SEQ ID NO: 14972 - RNA, 27 nt, Artificial Sequence
  Synthetic oligonucleotide
guuauuggacaccggaaacaauaaauu

SEQ ID NO: 14973 - RNA, 27 nt, Artificial Sequence
  Synthetic oligonucleotide
uuauuggacaccggaaacaauaaauug

SEQ ID NO: 14974 - RNA, 27 nt, Artificial Sequence
  Synthetic oligonucleotide
uauuggacaccggaaacaauaaauugg

SEQ ID NO: 14975 - RNA, 27 nt, Artificial Sequence
  Synthetic oligonucleotide
auuggacaccggaaacaauaaauugga

SEQ ID NO: 14976 - RNA, 27 nt, Artificial Sequence
  Synthetic oligonucleotide
uuggacaccggaaacaauaaauuggaa

SEQ ID NO: 14977 - RNA, 27 nt, Artificial Sequence
  Synthetic oligonucleotide
uggacaccggaaacaauaaauuggaac

SEQ ID NO: 14978 - RNA, 27 nt, Artificial Sequence
  Synthetic oligonucleotide
ggacaccggaaacaauaaauuggaaca

SEQ ID NO: 14979 - RNA, 27 nt, Artificial Sequence
  Synthetic oligonucleotide
uggaacaccuccucaaaccuaccacuc

SEQ ID NO: 14980 - RNA, 27 nt, Artificial Sequence
  Synthetic oligonucleotide
ggaacaccuccucaaaccuaccacuca

SEQ ID NO: 14981 - RNA, 27 nt, Artificial Sequence
  Synthetic oligonucleotide
gaacaccuccucaaaccuaccacucag

SEQ ID NO: 14982 - RNA, 27 nt, Artificial Sequence
  Synthetic oligonucleotide
aacaccuccucaaaccuaccacucagg

SEQ ID NO: 14983 - RNA, 27 nt, Artificial Sequence
  Synthetic oligonucleotide
acaccuccucaaaccuaccacucagga

SEQ ID NO: 14984 - RNA, 27 nt, Artificial Sequence
  Synthetic oligonucleotide
caccuccucaaaccuaccacucaggaa

SEQ ID NO: 14985 - RNA, 27 nt, Artificial Sequence
  Synthetic oligonucleotide
gggccgaaagaacaguccauugaaagg

SEQ ID NO: 14986 - RNA, 27 nt, Artificial Sequence
  Synthetic oligonucleotide
ggccgaaagaacaguccauugaaaggg

SEQ ID NO: 14987 - RNA, 27 nt, Artificial Sequence
  Synthetic oligonucleotide
gccgaaagaacaguccauugaaaggga

SEQ ID NO: 14988 - RNA, 27 nt, Artificial Sequence
  Synthetic oligonucleotide
ccgaaagaacaguccauugaaagggag

SEQ ID NO: 14989 - RNA, 27 nt, Artificial Sequence
  Synthetic oligonucleotide
cgaaagaacaguccauugaaagggagu

SEQ ID NO: 14990 - RNA, 27 nt, Artificial Sequence
  Synthetic oligonucleotide
agggaguauuacaaaaacauggccuuu

SEQ ID NO: 14991 - RNA, 27 nt, Artificial Sequence
  Synthetic oligonucleotide
gggaguauuacaaaaacauggccuuug

SEQ ID NO: 14992 - RNA, 27 nt, Artificial Sequence
  Synthetic oligonucleotide
ggaguauuacaaaaacauggccuuugc

SEQ ID NO: 14993 - RNA, 27 nt, Artificial Sequence
  Synthetic oligonucleotide
gaguauuacaaaaacauggccuuugcu

SEQ ID NO: 14994 - RNA, 27 nt, Artificial Sequence
  Synthetic oligonucleotide
aguauuacaaaaacauggccuuugcuu

SEQ ID NO: 14995 - RNA, 27 nt, Artificial Sequence
  Synthetic oligonucleotide
guauuacaaaaacauggccuuugcuug

SEQ ID NO: 14996 - RNA, 27 nt, Artificial Sequence
  Synthetic oligonucleotide
uauuacaaaaacauggccuuugcuuga

SEQ ID NO: 14997 - RNA, 27 nt, Artificial Sequence
  Synthetic oligonucleotide
auuacaaaaacauggccuuugcuugaa

SEQ ID NO: 14998 - RNA, 27 nt, Artificial Sequence
  Synthetic oligonucleotide
uuacaaaaacauggccuuugcuugaaa

SEQ ID NO: 14999 - RNA, 27 nt, Artificial Sequence
  Synthetic oligonucleotide
uacaaaaacauggccuuugcuugaaag

SEQ ID NO: 15000 - RNA, 27 nt, Artificial Sequence
  Synthetic oligonucleotide
acaaaaacauggccuuugcuugaaaga

SEQ ID NO: 15001 - RNA, 27 nt, Artificial Sequence
  Synthetic oligonucleotide
caaaaacauggccuuugcuugaaagaa

SEQ ID NO: 15002 - RNA, 27 nt, Artificial Sequence
  Synthetic oligonucleotide
aaaaacauggccuuugcuugaaagaaa

SEQ ID NO: 15003 - RNA, 27 nt, Artificial Sequence
  Synthetic oligonucleotide
aaaacauggccuuugcuugaaagaaaa

SEQ ID NO: 15004 - RNA, 27 nt, Artificial Sequence
  Synthetic oligonucleotide
aaacauggccuuugcuugaaagaaaau

SEQ ID NO: 15005 - RNA, 27 nt, Artificial Sequence
  Synthetic oligonucleotide
aacauggccuuugcuugaaagaaaaua

SEQ ID NO: 15006 - RNA, 27 nt, Artificial Sequence
  Synthetic oligonucleotide
acauggccuuugcuugaaagaaaauac

SEQ ID NO: 15007 - RNA, 27 nt, Artificial Sequence
  Synthetic oligonucleotide
cauggccuuugcuugaaagaaaauacc

SEQ ID NO: 15008 - RNA, 27 nt, Artificial Sequence
  Synthetic oligonucleotide
auggccuuugcuugaaagaaaauacca

SEQ ID NO: 15009 - RNA, 27 nt, Artificial Sequence
  Synthetic oligonucleotide
uggccuuugcuugaaagaaaauaccaa

SEQ ID NO: 15010 - RNA, 27 nt, Artificial Sequence
  Synthetic oligonucleotide
ggccuuugcuugaaagaaaauaccaag

SEQ ID NO: 15011 - RNA, 27 nt, Artificial Sequence
  Synthetic oligonucleotide
gccuuugcuugaaagaaaauaccaagg

SEQ ID NO: 15012 - RNA, 27 nt, Artificial Sequence
  Synthetic oligonucleotide
ccuuugcuugaaagaaaauaccaagga

SEQ ID NO: 15013 - RNA, 27 nt, Artificial Sequence
  Synthetic oligonucleotide
cuuugcuugaaagaaaauaccaaggaa

SEQ ID NO: 15014 - RNA, 27 nt, Artificial Sequence
  Synthetic oligonucleotide
uuugcuugaaagaaaauaccaaggaac

SEQ ID NO: 15015 - RNA, 27 nt, Artificial Sequence
  Synthetic oligonucleotide
gaacaggaaacugaucauuaaagccug

SEQ ID NO: 15016 - RNA, 27 nt, Artificial Sequence
  Synthetic oligonucleotide
aacaggaaacugaucauuaaagccuga

SEQ ID NO: 15017 - RNA, 27 nt, Artificial Sequence
  Synthetic oligonucleotide
acaggaaacugaucauuaaagccugag

SEQ ID NO: 15018 - RNA, 27 nt, Artificial Sequence
  Synthetic oligonucleotide
caggaaacugaucauuaaagccugagu

SEQ ID NO: 15019 - RNA, 27 nt, Artificial Sequence
  Synthetic oligonucleotide
aggaaacugaucauuaaagccugaguu

SEQ ID NO: 15020 - RNA, 27 nt, Artificial Sequence
  Synthetic oligonucleotide
ggaaacugaucauuaaagccugaguuu

SEQ ID NO: 15021 - RNA, 27 nt, Artificial Sequence
  Synthetic oligonucleotide
gaaacugaucauuaaagccugaguuug

SEQ ID NO: 15022 - RNA, 27 nt, Artificial Sequence
  Synthetic oligonucleotide
aaacugaucauuaaagccugaguuugc

SEQ ID NO: 15023 - RNA, 27 nt, Artificial Sequence
  Synthetic oligonucleotide
aacugaucauuaaagccugaguuugcu

SEQ ID NO: 15024 - RNA, 27 nt, Artificial Sequence
  Synthetic oligonucleotide
acugaucauuaaagccugaguuugcuu

SEQ ID NO: 15025 - RNA, 27 nt, Artificial Sequence
  Synthetic oligonucleotide
cugaucauuaaagccugaguuugcuuu

SEQ ID NO: 15026 - RNA, 27 nt, Artificial Sequence
  Synthetic oligonucleotide
ugaucauuaaagccugaguuugcuuuc

SEQ ID NO: 15027 - RNA, 27 nt, Artificial Sequence
  Synthetic oligonucleotide
gaucauuaaagccugaguuugcuuuca

SEQ ID NO: 15028 - RNA, 27 nt, Artificial Sequence
  Synthetic oligonucleotide
cauuaaagccugaguuugcuuucaaaa

SEQ ID NO: 15029 - RNA, 27 nt, Artificial Sequence
  Synthetic oligonucleotide
auuaaagccugaguuugcuuucaaaaa

SEQ ID NO: 15030 - RNA, 19 nt, Artificial Sequence
  Synthetic oligonucleotide
cugcuaccuccaaccaugg

SEQ ID NO: 15031 - RNA, 19 nt, Artificial Sequence
  Synthetic oligonucleotide
ugcuaccuccaaccauggg

SEQ ID NO: 15032 - RNA, 19 nt, Artificial Sequence
  Synthetic oligonucleotide
gcuaccuccaaccaugggc

SEQ ID NO: 15033 - RNA, 19 nt, Artificial Sequence
  Synthetic oligonucleotide
cuaccuccaaccaugggcc

SEQ ID NO: 15034 - RNA, 19 nt, Artificial Sequence
  Synthetic oligonucleotide
ccuccaaccaugggccuuu

SEQ ID NO: 15035 - RNA, 19 nt, Artificial Sequence
  Synthetic oligonucleotide
cuccaaccaugggccuuuu

SEQ ID NO: 15036 - RNA, 19 nt, Artificial Sequence
  Synthetic oligonucleotide
uccaaccaugggccuuuug

SEQ ID NO: 15037 - RNA, 19 nt, Artificial Sequence
  Synthetic oligonucleotide
ccaaccaugggccuuuugg

SEQ ID NO: 15038 - RNA, 19 nt, Artificial Sequence
  Synthetic oligonucleotide
caaccaugggccuuuuggg

SEQ ID NO: 15039 - RNA, 19 nt, Artificial Sequence
  Synthetic oligonucleotide
aaccaugggccuuuuggga

SEQ ID NO: 15040 - RNA, 19 nt, Artificial Sequence
  Synthetic oligonucleotide
accaugggccuuuugggaa

SEQ ID NO: 15041 - RNA, 19 nt, Artificial Sequence
  Synthetic oligonucleotide
ccaugggccuuuugggaau

SEQ ID NO: 15042 - RNA, 19 nt, Artificial Sequence
  Synthetic oligonucleotide
caugggccuuuugggaaua

SEQ ID NO: 15043 - RNA, 19 nt, Artificial Sequence
  Synthetic oligonucleotide
augggccuuuugggaauac

SEQ ID NO: 15044 - RNA, 19 nt, Artificial Sequence
  Synthetic oligonucleotide
ugggccuuuugggaauacu

SEQ ID NO: 15045 - RNA, 19 nt, Artificial Sequence
  Synthetic oligonucleotide
gggccuuuugggaauacuu

SEQ ID NO: 15046 - RNA, 19 nt, Artificial Sequence
  Synthetic oligonucleotide
ggccuuuugggaauacuuu

SEQ ID NO: 15047 - RNA, 19 nt, Artificial Sequence
  Synthetic oligonucleotide
gccuuuugggaauacuuug

SEQ ID NO: 15048 - RNA, 19 nt, Artificial Sequence
  Synthetic oligonucleotide
ccuuuugggaauacuuugu

SEQ ID NO: 15049 - RNA, 19 nt, Artificial Sequence
  Synthetic oligonucleotide
cuuuugggaauacuuuguu

SEQ ID NO: 15050 - RNA, 19 nt, Artificial Sequence
  Synthetic oligonucleotide
uuuugggaauacuuuguuu

SEQ ID NO: 15051 - RNA, 19 nt, Artificial Sequence
  Synthetic oligonucleotide
uuugggaauacuuuguuuu

SEQ ID NO: 15052 - RNA, 19 nt, Artificial Sequence
  Synthetic oligonucleotide
uugggaauacuuuguuuuu

SEQ ID NO: 15053 - RNA, 19 nt, Artificial Sequence
  Synthetic oligonucleotide
ugggaauacuuuguuuuuu

SEQ ID NO: 15054 - RNA, 19 nt, Artificial Sequence
  Synthetic oligonucleotide
gggaauacuuuguuuuuua

SEQ ID NO: 15055 - RNA, 19 nt, Artificial Sequence
  Synthetic oligonucleotide
ggaauacuuuguuuuuuaa

SEQ ID NO: 15056 - RNA, 19 nt, Artificial Sequence
  Synthetic oligonucleotide
gaauacuuuguuuuuuaau

SEQ ID NO: 15057 - RNA, 19 nt, Artificial Sequence
  Synthetic oligonucleotide
aauacuuuguuuuuuaauc

SEQ ID NO: 15058 - RNA, 19 nt, Artificial Sequence
  Synthetic oligonucleotide
auacuuuguuuuuuaaucu

SEQ ID NO: 15059 - RNA, 19 nt, Artificial Sequence
  Synthetic oligonucleotide
uacuuuguuuuuuaaucuu

SEQ ID NO: 15060 - RNA, 19 nt, Artificial Sequence
  Synthetic oligonucleotide
acuuuguuuuuuaaucuuc

SEQ ID NO: 15061 - RNA, 19 nt, Artificial Sequence
  Synthetic oligonucleotide
cuuuguuuuuuaaucuucc

SEQ ID NO: 15062 - RNA, 19 nt, Artificial Sequence
  Synthetic oligonucleotide
uuuguuuuuuaaucuuccu

SEQ ID NO: 15063 - RNA, 19 nt, Artificial Sequence
  Synthetic oligonucleotide
uuguuuuuuaaucuuccug

SEQ ID NO: 15064 - RNA, 19 nt, Artificial Sequence
  Synthetic oligonucleotide
uguuuuuuaaucuuccugg

SEQ ID NO: 15065 - RNA, 19 nt, Artificial Sequence
  Synthetic oligonucleotide
guuuuuuaaucuuccuggg

SEQ ID NO: 15066 - RNA, 19 nt, Artificial Sequence
  Synthetic oligonucleotide
uggggacaggagcaaacau

SEQ ID NO: 15067 - RNA, 19 nt, Artificial Sequence
  Synthetic oligonucleotide
ggggacaggagcaaacaua

SEQ ID NO: 15068 - RNA, 19 nt, Artificial Sequence
  Synthetic oligonucleotide
gggacaggagcaaacauau

SEQ ID NO: 15069 - RNA, 19 nt, Artificial Sequence
  Synthetic oligonucleotide
ggacaggagcaaacauaug

SEQ ID NO: 15070 - RNA, 19 nt, Artificial Sequence
  Synthetic oligonucleotide
gacaggagcaaacauaugu

SEQ ID NO: 15071 - RNA, 19 nt, Artificial Sequence
  Synthetic oligonucleotide
acaggagcaaacauauguc

SEQ ID NO: 15072 - RNA, 19 nt, Artificial Sequence
  Synthetic oligonucleotide
caggagcaaacauauguca

SEQ ID NO: 15073 - RNA, 19 nt, Artificial Sequence
  Synthetic oligonucleotide
aggagcaaacauaugucau

SEQ ID NO: 15074 - RNA, 19 nt, Artificial Sequence
  Synthetic oligonucleotide
ggagcaaacauaugucauu

SEQ ID NO: 15075 - RNA, 19 nt, Artificial Sequence
  Synthetic oligonucleotide
gagcaaacauaugucauuu

SEQ ID NO: 15076 - RNA, 19 nt, Artificial Sequence
  Synthetic oligonucleotide
agcaaacauaugucauuuc

SEQ ID NO: 15077 - RNA, 19 nt, Artificial Sequence
  Synthetic oligonucleotide
gcaaacauaugucauuuca

SEQ ID NO: 15078 - RNA, 19 nt, Artificial Sequence
  Synthetic oligonucleotide
caaacauaugucauuucag

SEQ ID NO: 15079 - RNA, 19 nt, Artificial Sequence
  Synthetic oligonucleotide
aaacauaugucauuucagc

SEQ ID NO: 15080 - RNA, 19 nt, Artificial Sequence
  Synthetic oligonucleotide
aacauaugucauuucagca

SEQ ID NO: 15081 - RNA, 19 nt, Artificial Sequence
  Synthetic oligonucleotide
acauaugucauuucagcac

SEQ ID NO: 15082 - RNA, 19 nt, Artificial Sequence
  Synthetic oligonucleotide
cauaugucauuucagcacc

SEQ ID NO: 15083 - RNA, 19 nt, Artificial Sequence
  Synthetic oligonucleotide
uaugucauuucagcaccaa

SEQ ID NO: 15084 - RNA, 19 nt, Artificial Sequence
  Synthetic oligonucleotide
augucauuucagcaccaaa

SEQ ID NO: 15085 - RNA, 19 nt, Artificial Sequence
  Synthetic oligonucleotide
ugucauuucagcaccaaaa

SEQ ID NO: 15086 - RNA, 19 nt, Artificial Sequence
  Synthetic oligonucleotide
gucauuucagcaccaaaaa

SEQ ID NO: 15087 - RNA, 19 nt, Artificial Sequence
  Synthetic oligonucleotide
ucauuucagcaccaaaaau

SEQ ID NO: 15088 - RNA, 19 nt, Artificial Sequence
  Synthetic oligonucleotide
cauuucagcaccaaaaaua

SEQ ID NO: 15089 - RNA, 19 nt, Artificial Sequence
  Synthetic oligonucleotide
auuucagcaccaaaaauau

SEQ ID NO: 15090 - RNA, 19 nt, Artificial Sequence
  Synthetic oligonucleotide
uuucagcaccaaaaauauu

SEQ ID NO: 15091 - RNA, 19 nt, Artificial Sequence
  Synthetic oligonucleotide
uucagcaccaaaaauauuc

SEQ ID NO: 15092 - RNA, 19 nt, Artificial Sequence
  Synthetic oligonucleotide
ucagcaccaaaaauauucc

SEQ ID NO: 15093 - RNA, 19 nt, Artificial Sequence
  Synthetic oligonucleotide
cagcaccaaaaauauuccg

SEQ ID NO: 15094 - RNA, 19 nt, Artificial Sequence
  Synthetic oligonucleotide
agcaccaaaaauauuccgu

SEQ ID NO: 15095 - RNA, 19 nt, Artificial Sequence
  Synthetic oligonucleotide
gcaccaaaaauauuccgug

SEQ ID NO: 15096 - RNA, 19 nt, Artificial Sequence
  Synthetic oligonucleotide
caccaaaaauauuccgugu

SEQ ID NO: 15097 - RNA, 19 nt, Artificial Sequence
  Synthetic oligonucleotide
accaaaaauauuccguguu

SEQ ID NO: 15098 - RNA, 19 nt, Artificial Sequence
  Synthetic oligonucleotide
ccaaaaauauuccguguug

SEQ ID NO: 15099 - RNA, 19 nt, Artificial Sequence
  Synthetic oligonucleotide
caaaaauauuccguguugg

SEQ ID NO: 15100 - RNA, 19 nt, Artificial Sequence
  Synthetic oligonucleotide
aaaaauauuccguguugga

SEQ ID NO: 15101 - RNA, 19 nt, Artificial Sequence
  Synthetic oligonucleotide
aaaauauuccguguuggag

SEQ ID NO: 15102 - RNA, 19 nt, Artificial Sequence
  Synthetic oligonucleotide
aaauauuccguguuggagc

SEQ ID NO: 15103 - RNA, 19 nt, Artificial Sequence
  Synthetic oligonucleotide
aauauuccguguuggagca

SEQ ID NO: 15104 - RNA, 19 nt, Artificial Sequence
  Synthetic oligonucleotide
auauuccguguuggagcau

SEQ ID NO: 15105 - RNA, 19 nt, Artificial Sequence
  Synthetic oligonucleotide
uauuccguguuggagcauc

SEQ ID NO: 15106 - RNA, 19 nt, Artificial Sequence
  Synthetic oligonucleotide
auuccguguuggagcaucu

SEQ ID NO: 15107 - RNA, 19 nt, Artificial Sequence
  Synthetic oligonucleotide
uuccguguuggagcaucug

SEQ ID NO: 15108 - RNA, 19 nt, Artificial Sequence
  Synthetic oligonucleotide
uccguguuggagcaucuga

SEQ ID NO: 15109 - RNA, 19 nt, Artificial Sequence
  Synthetic oligonucleotide
ccguguuggagcaucugaa

SEQ ID NO: 15110 - RNA, 19 nt, Artificial Sequence
  Synthetic oligonucleotide
cguguuggagcaucugaaa

SEQ ID NO: 15111 - RNA, 19 nt, Artificial Sequence
  Synthetic oligonucleotide
guguuggagcaucugaaaa

SEQ ID NO: 15112 - RNA, 19 nt, Artificial Sequence
  Synthetic oligonucleotide
guuuauggauacacugaag

SEQ ID NO: 15113 - RNA, 19 nt, Artificial Sequence
  Synthetic oligonucleotide
uauggauacacugaagcau

SEQ ID NO: 15114 - RNA, 19 nt, Artificial Sequence
  Synthetic oligonucleotide
uggauacacugaagcauuu

SEQ ID NO: 15115 - RNA, 19 nt, Artificial Sequence
  Synthetic oligonucleotide
ugaagcauuugaugcaaca

SEQ ID NO: 15116 - RNA, 19 nt, Artificial Sequence
  Synthetic oligonucleotide
aagcauuugaugcaacaau

SEQ ID NO: 15117 - RNA, 19 nt, Artificial Sequence
  Synthetic oligonucleotide
gcauuugaugcaacaaucu

SEQ ID NO: 15118 - RNA, 19 nt, Artificial Sequence
  Synthetic oligonucleotide
auuugaugcaacaaucucu

SEQ ID NO: 15119 - RNA, 19 nt, Artificial Sequence
  Synthetic oligonucleotide
uuugaugcaacaaucucua

SEQ ID NO: 15120 - RNA, 19 nt, Artificial Sequence
  Synthetic oligonucleotide
uugaugcaacaaucucuau

SEQ ID NO: 15121 - RNA, 19 nt, Artificial Sequence
  Synthetic oligonucleotide
gcaacaaucucuauuaaaa

SEQ ID NO: 15122 - RNA, 19 nt, Artificial Sequence
  Synthetic oligonucleotide
caacaaucucuauuaaaag

SEQ ID NO: 15123 - RNA, 19 nt, Artificial Sequence
  Synthetic oligonucleotide
aacaaucucuauuaaaagu

SEQ ID NO: 15124 - RNA, 19 nt, Artificial Sequence
  Synthetic oligonucleotide
aaucucuauuaaaaguuau

SEQ ID NO: 15125 - RNA, 19 nt, Artificial Sequence
  Synthetic oligonucleotide
aucucuauuaaaaguuauc

SEQ ID NO: 15126 - RNA, 19 nt, Artificial Sequence
  Synthetic oligonucleotide
ucucuauuaaaaguuaucc

SEQ ID NO: 15127 - RNA, 19 nt, Artificial Sequence
  Synthetic oligonucleotide
cucuauuaaaaguuauccu

SEQ ID NO: 15128 - RNA, 19 nt, Artificial Sequence
  Synthetic oligonucleotide
ucuauuaaaaguuauccug

SEQ ID NO: 15129 - RNA, 19 nt, Artificial Sequence
  Synthetic oligonucleotide
uauuaaaaguuauccugau

SEQ ID NO: 15130 - RNA, 19 nt, Artificial Sequence
  Synthetic oligonucleotide
uuaaaaguuauccugauaa

SEQ ID NO: 15131 - RNA, 19 nt, Artificial Sequence
  Synthetic oligonucleotide
uaaaaguuauccugauaaa

SEQ ID NO: 15132 - RNA, 19 nt, Artificial Sequence
  Synthetic oligonucleotide
aaguuauccugauaaaaaa

SEQ ID NO: 15133 - RNA, 19 nt, Artificial Sequence
  Synthetic oligonucleotide
aguuauccugauaaaaaau

SEQ ID NO: 15134 - RNA, 19 nt, Artificial Sequence
  Synthetic oligonucleotide
uauccugauaaaaaauuua

SEQ ID NO: 15135 - RNA, 19 nt, Artificial Sequence
  Synthetic oligonucleotide
auccugauaaaaaauuuag

SEQ ID NO: 15136 - RNA, 19 nt, Artificial Sequence
  Synthetic oligonucleotide
uccugauaaaaaauuuagu

SEQ ID NO: 15137 - RNA, 19 nt, Artificial Sequence
  Synthetic oligonucleotide
ccugauaaaaaauuuaguu

SEQ ID NO: 15138 - RNA, 19 nt, Artificial Sequence
  Synthetic oligonucleotide
cugauaaaaaauuuaguua

SEQ ID NO: 15139 - RNA, 19 nt, Artificial Sequence
  Synthetic oligonucleotide
ugauaaaaaauuuaguuac

SEQ ID NO: 15140 - RNA, 19 nt, Artificial Sequence
  Synthetic oligonucleotide
gauaaaaaauuuaguuacu

SEQ ID NO: 15141 - RNA, 19 nt, Artificial Sequence
  Synthetic oligonucleotide
auaaaaaauuuaguuacuc

SEQ ID NO: 15142 - RNA, 19 nt, Artificial Sequence
  Synthetic oligonucleotide
uaaaaaauuuaguuacucc

SEQ ID NO: 15143 - RNA, 19 nt, Artificial Sequence
  Synthetic oligonucleotide
aaaaaauuuaguuacuccu

SEQ ID NO: 15144 - RNA, 19 nt, Artificial Sequence
  Synthetic oligonucleotide
aaaaauuuaguuacuccuc

SEQ ID NO: 15145 - RNA, 19 nt, Artificial Sequence
  Synthetic oligonucleotide
aaaauuuaguuacuccuca

SEQ ID NO: 15146 - RNA, 19 nt, Artificial Sequence
  Synthetic oligonucleotide
aaauuuaguuacuccucag

SEQ ID NO: 15147 - RNA, 19 nt, Artificial Sequence
  Synthetic oligonucleotide
aauuuaguuacuccucagg

SEQ ID NO: 15148 - RNA, 19 nt, Artificial Sequence
  Synthetic oligonucleotide
auuuaguuacuccucaggc

SEQ ID NO: 15149 - RNA, 19 nt, Artificial Sequence
  Synthetic oligonucleotide
uuuaguuacuccucaggcc

SEQ ID NO: 15150 - RNA, 19 nt, Artificial Sequence
  Synthetic oligonucleotide
uuaguuacuccucaggcca

SEQ ID NO: 15151 - RNA, 19 nt, Artificial Sequence
  Synthetic oligonucleotide
uaguuacuccucaggccau

SEQ ID NO: 15152 - RNA, 19 nt, Artificial Sequence
  Synthetic oligonucleotide
aguuacuccucaggccaug

SEQ ID NO: 15153 - RNA, 19 nt, Artificial Sequence
  Synthetic oligonucleotide
guuacuccucaggccaugu

SEQ ID NO: 15154 - RNA, 19 nt, Artificial Sequence
  Synthetic oligonucleotide
uuacuccucaggccauguu

SEQ ID NO: 15155 - RNA, 19 nt, Artificial Sequence
  Synthetic oligonucleotide
uacuccucaggccauguuc

SEQ ID NO: 15156 - RNA, 19 nt, Artificial Sequence
  Synthetic oligonucleotide
acuccucaggccauguuca

SEQ ID NO: 15157 - RNA, 19 nt, Artificial Sequence
  Synthetic oligonucleotide
cuccucaggccauguucau

SEQ ID NO: 15158 - RNA, 19 nt, Artificial Sequence
  Synthetic oligonucleotide
uccucaggccauguucauu

SEQ ID NO: 15159 - RNA, 19 nt, Artificial Sequence
  Synthetic oligonucleotide
ccucaggccauguucauuu

SEQ ID NO: 15160 - RNA, 19 nt, Artificial Sequence
  Synthetic oligonucleotide
cucaggccauguucauuua

SEQ ID NO: 15161 - RNA, 19 nt, Artificial Sequence
  Synthetic oligonucleotide
ucaggccauguucauuuau

SEQ ID NO: 15162 - RNA, 19 nt, Artificial Sequence
  Synthetic oligonucleotide
caggccauguucauuuauc

SEQ ID NO: 15163 - RNA, 19 nt, Artificial Sequence
  Synthetic oligonucleotide
aggccauguucauuuaucc

SEQ ID NO: 15164 - RNA, 19 nt, Artificial Sequence
  Synthetic oligonucleotide
ggccauguucauuuauccu

SEQ ID NO: 15165 - RNA, 19 nt, Artificial Sequence
  Synthetic oligonucleotide
gccauguucauuuauccuc

SEQ ID NO: 15166 - RNA, 19 nt, Artificial Sequence
  Synthetic oligonucleotide
ccauguucauuuauccuca

SEQ ID NO: 15167 - RNA, 19 nt, Artificial Sequence
  Synthetic oligonucleotide
cauguucauuuauccucag

SEQ ID NO: 15168 - RNA, 19 nt, Artificial Sequence
  Synthetic oligonucleotide
auguucauuuauccucaga

SEQ ID NO: 15169 - RNA, 19 nt, Artificial Sequence
  Synthetic oligonucleotide
uguucauuuauccucagag

SEQ ID NO: 15170 - RNA, 19 nt, Artificial Sequence
  Synthetic oligonucleotide
ucauuuauccucagagaau

SEQ ID NO: 15171 - RNA, 19 nt, Artificial Sequence
  Synthetic oligonucleotide
cauuuauccucagagaaua

SEQ ID NO: 15172 - RNA, 19 nt, Artificial Sequence
  Synthetic oligonucleotide
auuuauccucagagaauaa

SEQ ID NO: 15173 - RNA, 19 nt, Artificial Sequence
  Synthetic oligonucleotide
uuuauccucagagaauaaa

SEQ ID NO: 15174 - RNA, 19 nt, Artificial Sequence
  Synthetic oligonucleotide
uuauccucagagaauaaau

SEQ ID NO: 15175 - RNA, 19 nt, Artificial Sequence
  Synthetic oligonucleotide
uauccucagagaauaaauu

SEQ ID NO: 15176 - RNA, 19 nt, Artificial Sequence
  Synthetic oligonucleotide
auccucagagaauaaauuc

SEQ ID NO: 15177 - RNA, 19 nt, Artificial Sequence
  Synthetic oligonucleotide
uccucagagaauaaauucc

SEQ ID NO: 15178 - RNA, 19 nt, Artificial Sequence
  Synthetic oligonucleotide
ccucagagaauaaauucca

SEQ ID NO: 15179 - RNA, 19 nt, Artificial Sequence
  Synthetic oligonucleotide
cucagagaauaaauuccaa

SEQ ID NO: 15180 - RNA, 19 nt, Artificial Sequence
  Synthetic oligonucleotide
ucagagaauaaauuccaaa

SEQ ID NO: 15181 - RNA, 19 nt, Artificial Sequence
  Synthetic oligonucleotide
cagagaauaaauuccaaaa

SEQ ID NO: 15182 - RNA, 19 nt, Artificial Sequence
  Synthetic oligonucleotide
agagaauaaauuccaaaac

SEQ ID NO: 15183 - RNA, 19 nt, Artificial Sequence
  Synthetic oligonucleotide
gagaauaaauuccaaaacu

SEQ ID NO: 15184 - RNA, 19 nt, Artificial Sequence
  Synthetic oligonucleotide
agaauaaauuccaaaacuc

SEQ ID NO: 15185 - RNA, 19 nt, Artificial Sequence
  Synthetic oligonucleotide
ucuuaacaauacaaccaaa

SEQ ID NO: 15186 - RNA, 19 nt, Artificial Sequence
  Synthetic oligonucleotide
cuuaacaauacaaccaaaa

SEQ ID NO: 15187 - RNA, 19 nt, Artificial Sequence
  Synthetic oligonucleotide
uuaacaauacaaccaaaac

SEQ ID NO: 15188 - RNA, 19 nt, Artificial Sequence
  Synthetic oligonucleotide
uaacaauacaaccaaaaca

SEQ ID NO: 15189 - RNA, 19 nt, Artificial Sequence
  Synthetic oligonucleotide
aacaauacaaccaaaacaa

SEQ ID NO: 15190 - RNA, 19 nt, Artificial Sequence
  Synthetic oligonucleotide
acaauacaaccaaaacaau

SEQ ID NO: 15191 - RNA, 19 nt, Artificial Sequence
  Synthetic oligonucleotide
caauacaaccaaaacaauu

SEQ ID NO: 15192 - RNA, 19 nt, Artificial Sequence
  Synthetic oligonucleotide
auuuggaaguuguaucaaa

SEQ ID NO: 15193 - RNA, 19 nt, Artificial Sequence
  Synthetic oligonucleotide
uuuggaaguuguaucaaag

SEQ ID NO: 15194 - RNA, 19 nt, Artificial Sequence
  Synthetic oligonucleotide
uaucaaagcauuuuucaaa

SEQ ID NO: 15195 - RNA, 19 nt, Artificial Sequence
  Synthetic oligonucleotide
aucaaagcauuuuucaaaa

SEQ ID NO: 15196 - RNA, 19 nt, Artificial Sequence
  Synthetic oligonucleotide
ucaaagcauuuuucaaaau

SEQ ID NO: 15197 - RNA, 19 nt, Artificial Sequence
  Synthetic oligonucleotide
caaagcauuuuucaaaauc

SEQ ID NO: 15198 - RNA, 19 nt, Artificial Sequence
  Synthetic oligonucleotide
aaagcauuuuucaaaauca

SEQ ID NO: 15199 - RNA, 19 nt, Artificial Sequence
  Synthetic oligonucleotide
ccaauaaccuaugacaaug

SEQ ID NO: 15200 - RNA, 19 nt, Artificial Sequence
  Synthetic oligonucleotide
caauaaccuaugacaaugg

SEQ ID NO: 15201 - RNA, 19 nt, Artificial Sequence
  Synthetic oligonucleotide
auaaccuaugacaauggau

SEQ ID NO: 15202 - RNA, 19 nt, Artificial Sequence
  Synthetic oligonucleotide
uaaccuaugacaauggauu

SEQ ID NO: 15203 - RNA, 19 nt, Artificial Sequence
  Synthetic oligonucleotide
aaccuaugacaauggauuu

SEQ ID NO: 15204 - RNA, 19 nt, Artificial Sequence
  Synthetic oligonucleotide
accuaugacaauggauuuc

SEQ ID NO: 15205 - RNA, 19 nt, Artificial Sequence
  Synthetic oligonucleotide
ccuaugacaauggauuucu

SEQ ID NO: 15206 - RNA, 19 nt, Artificial Sequence
  Synthetic oligonucleotide
uaugacaauggauuucucu

SEQ ID NO: 15207 - RNA, 19 nt, Artificial Sequence
  Synthetic oligonucleotide
augacaauggauuucucuu

SEQ ID NO: 15208 - RNA, 19 nt, Artificial Sequence
  Synthetic oligonucleotide
ugacaauggauuucucuuc

SEQ ID NO: 15209 - RNA, 19 nt, Artificial Sequence
  Synthetic oligonucleotide
aauggauuucucuucauuc

SEQ ID NO: 15210 - RNA, 19 nt, Artificial Sequence
  Synthetic oligonucleotide
ggauuucucuucauucaua

SEQ ID NO: 15211 - RNA, 19 nt, Artificial Sequence
  Synthetic oligonucleotide
auuucucuucauucauaca

SEQ ID NO: 15212 - RNA, 19 nt, Artificial Sequence
  Synthetic oligonucleotide
uuucucuucauucauacag

SEQ ID NO: 15213 - RNA, 19 nt, Artificial Sequence
  Synthetic oligonucleotide
uucucuucauucauacaga

SEQ ID NO: 15214 - RNA, 19 nt, Artificial Sequence
  Synthetic oligonucleotide
ucucuucauucauacagac

SEQ ID NO: 15215 - RNA, 19 nt, Artificial Sequence
  Synthetic oligonucleotide
cucuucauucauacagaca

SEQ ID NO: 15216 - RNA, 19 nt, Artificial Sequence
  Synthetic oligonucleotide
ucuucauucauacagacaa

SEQ ID NO: 15217 - RNA, 19 nt, Artificial Sequence
  Synthetic oligonucleotide
cuucauucauacagacaaa

SEQ ID NO: 15218 - RNA, 19 nt, Artificial Sequence
  Synthetic oligonucleotide
uucauucauacagacaaac

SEQ ID NO: 15219 - RNA, 19 nt, Artificial Sequence
  Synthetic oligonucleotide
ucauucauacagacaaacc

SEQ ID NO: 15220 - RNA, 19 nt, Artificial Sequence
  Synthetic oligonucleotide
cauucauacagacaaaccu

SEQ ID NO: 15221 - RNA, 19 nt, Artificial Sequence
  Synthetic oligonucleotide
uucauacagacaaaccugu

SEQ ID NO: 15222 - RNA, 19 nt, Artificial Sequence
  Synthetic oligonucleotide
uacagacaaaccuguuuau

SEQ ID NO: 15223 - RNA, 19 nt, Artificial Sequence
  Synthetic oligonucleotide
acagacaaaccuguuuaua

SEQ ID NO: 15224 - RNA, 19 nt, Artificial Sequence
  Synthetic oligonucleotide
cagacaaaccuguuuauac

SEQ ID NO: 15225 - RNA, 19 nt, Artificial Sequence
  Synthetic oligonucleotide
agacaaaccuguuuauacu

SEQ ID NO: 15226 - RNA, 19 nt, Artificial Sequence
  Synthetic oligonucleotide
gacaaaccuguuuauacuc

SEQ ID NO: 15227 - RNA, 19 nt, Artificial Sequence
  Synthetic oligonucleotide
acaaaccuguuuauacucc

SEQ ID NO: 15228 - RNA, 19 nt, Artificial Sequence
  Synthetic oligonucleotide
caaaccuguuuauacucca

SEQ ID NO: 15229 - RNA, 19 nt, Artificial Sequence
  Synthetic oligonucleotide
aaaccuguuuauacuccag

SEQ ID NO: 15230 - RNA, 19 nt, Artificial Sequence
  Synthetic oligonucleotide
aaccuguuuauacuccaga

SEQ ID NO: 15231 - RNA, 19 nt, Artificial Sequence
  Synthetic oligonucleotide
accuguuuauacuccagac

SEQ ID NO: 15232 - RNA, 19 nt, Artificial Sequence
  Synthetic oligonucleotide
ccuguuuauacuccagacc

SEQ ID NO: 15233 - RNA, 19 nt, Artificial Sequence
  Synthetic oligonucleotide
cuguuuauacuccagacca

SEQ ID NO: 15234 - RNA, 19 nt, Artificial Sequence
  Synthetic oligonucleotide
uuagaguuuauucguugaa

SEQ ID NO: 15235 - RNA, 19 nt, Artificial Sequence
  Synthetic oligonucleotide
uagaguuuauucguugaau

SEQ ID NO: 15236 - RNA, 19 nt, Artificial Sequence
  Synthetic oligonucleotide
agaguuuauucguugaaug

SEQ ID NO: 15237 - RNA, 19 nt, Artificial Sequence
  Synthetic oligonucleotide
gaguuuauucguugaauga

SEQ ID NO: 15238 - RNA, 19 nt, Artificial Sequence
  Synthetic oligonucleotide
gacuugaagccagccaaaa

SEQ ID NO: 15239 - RNA, 19 nt, Artificial Sequence
  Synthetic oligonucleotide
acuugaagccagccaaaag

SEQ ID NO: 15240 - RNA, 19 nt, Artificial Sequence
  Synthetic oligonucleotide
cuugaagccagccaaaaga

SEQ ID NO: 15241 - RNA, 19 nt, Artificial Sequence
  Synthetic oligonucleotide
uugaagccagccaaaagag

SEQ ID NO: 15242 - RNA, 19 nt, Artificial Sequence
  Synthetic oligonucleotide
ugaagccagccaaaagaga

SEQ ID NO: 15243 - RNA, 19 nt, Artificial Sequence
  Synthetic oligonucleotide
gaagccagccaaaagagaa

SEQ ID NO: 15244 - RNA, 19 nt, Artificial Sequence
  Synthetic oligonucleotide
aagccagccaaaagagaaa

SEQ ID NO: 15245 - RNA, 19 nt, Artificial Sequence
  Synthetic oligonucleotide
agccagccaaaagagaaac

SEQ ID NO: 15246 - RNA, 19 nt, Artificial Sequence
  Synthetic oligonucleotide
gccagccaaaagagaaacu

SEQ ID NO: 15247 - RNA, 19 nt, Artificial Sequence
  Synthetic oligonucleotide
ccagccaaaagagaaacug

SEQ ID NO: 15248 - RNA, 19 nt, Artificial Sequence
  Synthetic oligonucleotide
cagccaaaagagaaacugu

SEQ ID NO: 15249 - RNA, 19 nt, Artificial Sequence
  Synthetic oligonucleotide
agccaaaagagaaacuguc

SEQ ID NO: 15250 - RNA, 19 nt, Artificial Sequence
  Synthetic oligonucleotide
gccaaaagagaaacugucu

SEQ ID NO: 15251 - RNA, 19 nt, Artificial Sequence
  Synthetic oligonucleotide
ccaaaagagaaacugucuu

SEQ ID NO: 15252 - RNA, 19 nt, Artificial Sequence
  Synthetic oligonucleotide
caaaagagaaacugucuua

SEQ ID NO: 15253 - RNA, 19 nt, Artificial Sequence
  Synthetic oligonucleotide
aaaagagaaacugucuuaa

SEQ ID NO: 15254 - RNA, 19 nt, Artificial Sequence
  Synthetic oligonucleotide
aaagagaaacugucuuaac

SEQ ID NO: 15255 - RNA, 19 nt, Artificial Sequence
  Synthetic oligonucleotide
aagagaaacugucuuaacu

SEQ ID NO: 15256 - RNA, 19 nt, Artificial Sequence
  Synthetic oligonucleotide
agagaaacugucuuaacuu

SEQ ID NO: 15257 - RNA, 19 nt, Artificial Sequence
  Synthetic oligonucleotide
gagaaacugucuuaacuuu

SEQ ID NO: 15258 - RNA, 19 nt, Artificial Sequence
  Synthetic oligonucleotide
gaaacugucuuaacuuuca

SEQ ID NO: 15259 - RNA, 19 nt, Artificial Sequence
  Synthetic oligonucleotide
aaacugucuuaacuuucau

SEQ ID NO: 15260 - RNA, 19 nt, Artificial Sequence
  Synthetic oligonucleotide
aacugucuuaacuuucaua

SEQ ID NO: 15261 - RNA, 19 nt, Artificial Sequence
  Synthetic oligonucleotide
ugucuuaacuuucauagau

SEQ ID NO: 15262 - RNA, 19 nt, Artificial Sequence
  Synthetic oligonucleotide
gucuuaacuuucauagauc

SEQ ID NO: 15263 - RNA, 19 nt, Artificial Sequence
  Synthetic oligonucleotide
ucuuaacuuucauagaucc

SEQ ID NO: 15264 - RNA, 19 nt, Artificial Sequence
  Synthetic oligonucleotide
cuuaacuuucauagauccu

SEQ ID NO: 15265 - RNA, 19 nt, Artificial Sequence
  Synthetic oligonucleotide
uuaacuuucauagauccug

SEQ ID NO: 15266 - RNA, 19 nt, Artificial Sequence
  Synthetic oligonucleotide
uaacuuucauagauccuga

SEQ ID NO: 15267 - RNA, 19 nt, Artificial Sequence
  Synthetic oligonucleotide
aacuuucauagauccugaa

SEQ ID NO: 15268 - RNA, 19 nt, Artificial Sequence
  Synthetic oligonucleotide
acuuucauagauccugaag

SEQ ID NO: 15269 - RNA, 19 nt, Artificial Sequence
  Synthetic oligonucleotide
cuuucauagauccugaagg

SEQ ID NO: 15270 - RNA, 19 nt, Artificial Sequence
  Synthetic oligonucleotide
uuucauagauccugaagga

SEQ ID NO: 15271 - RNA, 19 nt, Artificial Sequence
  Synthetic oligonucleotide
uucauagauccugaaggau

SEQ ID NO: 15272 - RNA, 19 nt, Artificial Sequence
  Synthetic oligonucleotide
ucauagauccugaaggauc

SEQ ID NO: 15273 - RNA, 19 nt, Artificial Sequence
  Synthetic oligonucleotide
cauagauccugaaggauca

SEQ ID NO: 15274 - RNA, 19 nt, Artificial Sequence
  Synthetic oligonucleotide
auagauccugaaggaucag

SEQ ID NO: 15275 - RNA, 19 nt, Artificial Sequence
  Synthetic oligonucleotide
uagauccugaaggaucaga

SEQ ID NO: 15276 - RNA, 19 nt, Artificial Sequence
  Synthetic oligonucleotide
agauccugaaggaucagaa

SEQ ID NO: 15277 - RNA, 19 nt, Artificial Sequence
  Synthetic oligonucleotide
uugacaugguagaagaaau

SEQ ID NO: 15278 - RNA, 19 nt, Artificial Sequence
  Synthetic oligonucleotide
ugacaugguagaagaaauu

SEQ ID NO: 15279 - RNA, 19 nt, Artificial Sequence
  Synthetic oligonucleotide
caugguagaagaaauugau

SEQ ID NO: 15280 - RNA, 19 nt, Artificial Sequence
  Synthetic oligonucleotide
augguagaagaaauugauc

SEQ ID NO: 15281 - RNA, 19 nt, Artificial Sequence
  Synthetic oligonucleotide
ugguagaagaaauugauca

SEQ ID NO: 15282 - RNA, 19 nt, Artificial Sequence
  Synthetic oligonucleotide
uagaagaaauugaucauau

SEQ ID NO: 15283 - RNA, 19 nt, Artificial Sequence
  Synthetic oligonucleotide
agaagaaauugaucauauu

SEQ ID NO: 15284 - RNA, 19 nt, Artificial Sequence
  Synthetic oligonucleotide
gaagaaauugaucauauug

SEQ ID NO: 15285 - RNA, 19 nt, Artificial Sequence
  Synthetic oligonucleotide
gaaauugaucauauuggaa

SEQ ID NO: 15286 - RNA, 19 nt, Artificial Sequence
  Synthetic oligonucleotide
aaauugaucauauuggaau

SEQ ID NO: 15287 - RNA, 19 nt, Artificial Sequence
  Synthetic oligonucleotide
aauugaucauauuggaauu

SEQ ID NO: 15288 - RNA, 19 nt, Artificial Sequence
  Synthetic oligonucleotide
auugaucauauuggaauua

SEQ ID NO: 15289 - RNA, 19 nt, Artificial Sequence
  Synthetic oligonucleotide
uugaucauauuggaauuau

SEQ ID NO: 15290 - RNA, 19 nt, Artificial Sequence
  Synthetic oligonucleotide
ugaucauauuggaauuauc

SEQ ID NO: 15291 - RNA, 19 nt, Artificial Sequence
  Synthetic oligonucleotide
gaucauauuggaauuaucu

SEQ ID NO: 15292 - RNA, 19 nt, Artificial Sequence
  Synthetic oligonucleotide
aucauauuggaauuaucuc

SEQ ID NO: 15293 - RNA, 19 nt, Artificial Sequence
  Synthetic oligonucleotide
ucauauuggaauuaucucu

SEQ ID NO: 15294 - RNA, 19 nt, Artificial Sequence
  Synthetic oligonucleotide
cauauuggaauuaucucuu

SEQ ID NO: 15295 - RNA, 19 nt, Artificial Sequence
  Synthetic oligonucleotide
auauuggaauuaucucuuu

SEQ ID NO: 15296 - RNA, 19 nt, Artificial Sequence
  Synthetic oligonucleotide
uauuggaauuaucucuuuu

SEQ ID NO: 15297 - RNA, 19 nt, Artificial Sequence
  Synthetic oligonucleotide
auuggaauuaucucuuuuc

SEQ ID NO: 15298 - RNA, 19 nt, Artificial Sequence
  Synthetic oligonucleotide
uuggaauuaucucuuuucc

SEQ ID NO: 15299 - RNA, 19 nt, Artificial Sequence
  Synthetic oligonucleotide
uggaauuaucucuuuuccu

SEQ ID NO: 15300 - RNA, 19 nt, Artificial Sequence
  Synthetic oligonucleotide
uccugacuucaagauuccg

SEQ ID NO: 15301 - RNA, 19 nt, Artificial Sequence
  Synthetic oligonucleotide
ccugacuucaagauuccgu

SEQ ID NO: 15302 - RNA, 19 nt, Artificial Sequence
  Synthetic oligonucleotide
cugacuucaagauuccguc

SEQ ID NO: 15303 - RNA, 19 nt, Artificial Sequence
  Synthetic oligonucleotide
ugacuucaagauuccgucu

SEQ ID NO: 15304 - RNA, 19 nt, Artificial Sequence
  Synthetic oligonucleotide
gacuucaagauuccgucua

SEQ ID NO: 15305 - RNA, 19 nt, Artificial Sequence
  Synthetic oligonucleotide
acuucaagauuccgucuaa

SEQ ID NO: 15306 - RNA, 19 nt, Artificial Sequence
  Synthetic oligonucleotide
cuucaagauuccgucuaau

SEQ ID NO: 15307 - RNA, 19 nt, Artificial Sequence
  Synthetic oligonucleotide
uucaagauuccgucuaauc

SEQ ID NO: 15308 - RNA, 19 nt, Artificial Sequence
  Synthetic oligonucleotide
ucaagauuccgucuaaucc

SEQ ID NO: 15309 - RNA, 19 nt, Artificial Sequence
  Synthetic oligonucleotide
caagauuccgucuaauccu

SEQ ID NO: 15310 - RNA, 19 nt, Artificial Sequence
  Synthetic oligonucleotide
aagauuccgucuaauccua

SEQ ID NO: 15311 - RNA, 19 nt, Artificial Sequence
  Synthetic oligonucleotide
agauuccgucuaauccuag

SEQ ID NO: 15312 - RNA, 19 nt, Artificial Sequence
  Synthetic oligonucleotide
gauuccgucuaauccuaga

SEQ ID NO: 15313 - RNA, 19 nt, Artificial Sequence
  Synthetic oligonucleotide
auuccgucuaauccuagau

SEQ ID NO: 15314 - RNA, 19 nt, Artificial Sequence
  Synthetic oligonucleotide
uuccgucuaauccuagaua

SEQ ID NO: 15315 - RNA, 19 nt, Artificial Sequence
  Synthetic oligonucleotide
uccgucuaauccuagauau

SEQ ID NO: 15316 - RNA, 19 nt, Artificial Sequence
  Synthetic oligonucleotide
ccgucuaauccuagauaug

SEQ ID NO: 15317 - RNA, 19 nt, Artificial Sequence
  Synthetic oligonucleotide
cgucuaauccuagauaugg

SEQ ID NO: 15318 - RNA, 19 nt, Artificial Sequence
  Synthetic oligonucleotide
gucuaauccuagauauggu

SEQ ID NO: 15319 - RNA, 19 nt, Artificial Sequence
  Synthetic oligonucleotide
ucuaauccuagauauggua

SEQ ID NO: 15320 - RNA, 19 nt, Artificial Sequence
  Synthetic oligonucleotide
cuaauccuagauaugguau

SEQ ID NO: 15321 - RNA, 19 nt, Artificial Sequence
  Synthetic oligonucleotide
uaauccuagauaugguaug

SEQ ID NO: 15322 - RNA, 19 nt, Artificial Sequence
  Synthetic oligonucleotide
aauccuagauaugguaugu

SEQ ID NO: 15323 - RNA, 19 nt, Artificial Sequence
  Synthetic oligonucleotide
auccuagauaugguaugug

SEQ ID NO: 15324 - RNA, 19 nt, Artificial Sequence
  Synthetic oligonucleotide
uccuagauaugguaugugg

SEQ ID NO: 15325 - RNA, 19 nt, Artificial Sequence
  Synthetic oligonucleotide
ccuagauaugguaugugga

SEQ ID NO: 15326 - RNA, 19 nt, Artificial Sequence
  Synthetic oligonucleotide
aggcuaaauauaaagagga

SEQ ID NO: 15327 - RNA, 19 nt, Artificial Sequence
  Synthetic oligonucleotide
ggcuaaauauaaagaggac

SEQ ID NO: 15328 - RNA, 19 nt, Artificial Sequence
  Synthetic oligonucleotide
gcuaaauauaaagaggacu

SEQ ID NO: 15329 - RNA, 19 nt, Artificial Sequence
  Synthetic oligonucleotide
cuaaauauaaagaggacuu

SEQ ID NO: 15330 - RNA, 19 nt, Artificial Sequence
  Synthetic oligonucleotide
uaaauauaaagaggacuuu

SEQ ID NO: 15331 - RNA, 19 nt, Artificial Sequence
  Synthetic oligonucleotide
aaauauaaagaggacuuuu

SEQ ID NO: 15332 - RNA, 19 nt, Artificial Sequence
  Synthetic oligonucleotide
aauauaaagaggacuuuuc

SEQ ID NO: 15333 - RNA, 19 nt, Artificial Sequence
  Synthetic oligonucleotide
auauaaagaggacuuuuca

SEQ ID NO: 15334 - RNA, 19 nt, Artificial Sequence
  Synthetic oligonucleotide
uauaaagaggacuuuucaa

SEQ ID NO: 15335 - RNA, 19 nt, Artificial Sequence
  Synthetic oligonucleotide
auaaagaggacuuuucaac

SEQ ID NO: 15336 - RNA, 19 nt, Artificial Sequence
  Synthetic oligonucleotide
uaaagaggacuuuucaaca

SEQ ID NO: 15337 - RNA, 19 nt, Artificial Sequence
  Synthetic oligonucleotide
aaagaggacuuuucaacaa

SEQ ID NO: 15338 - RNA, 19 nt, Artificial Sequence
  Synthetic oligonucleotide
aagaggacuuuucaacaac

SEQ ID NO: 15339 - RNA, 19 nt, Artificial Sequence
  Synthetic oligonucleotide
agaggacuuuucaacaacu

SEQ ID NO: 15340 - RNA, 19 nt, Artificial Sequence
  Synthetic oligonucleotide
gaggacuuuucaacaacug

SEQ ID NO: 15341 - RNA, 19 nt, Artificial Sequence
  Synthetic oligonucleotide
aggacuuuucaacaacugg

SEQ ID NO: 15342 - RNA, 19 nt, Artificial Sequence
  Synthetic oligonucleotide
ggacuuuucaacaacugga

SEQ ID NO: 15343 - RNA, 19 nt, Artificial Sequence
  Synthetic oligonucleotide
gacuuuucaacaacuggaa

SEQ ID NO: 15344 - RNA, 19 nt, Artificial Sequence
  Synthetic oligonucleotide
acuuuucaacaacuggaac

SEQ ID NO: 15345 - RNA, 19 nt, Artificial Sequence
  Synthetic oligonucleotide
uuuugaaguuaaagaauau

SEQ ID NO: 15346 - RNA, 19 nt, Artificial Sequence
  Synthetic oligonucleotide
uuugaaguuaaagaauaug

SEQ ID NO: 15347 - RNA, 19 nt, Artificial Sequence
  Synthetic oligonucleotide
uugaaguuaaagaauaugu

SEQ ID NO: 15348 - RNA, 19 nt, Artificial Sequence
  Synthetic oligonucleotide
ugaaguuaaagaauauguc

SEQ ID NO: 15349 - RNA, 19 nt, Artificial Sequence
  Synthetic oligonucleotide
gaaguuaaagaauaugucu

SEQ ID NO: 15350 - RNA, 19 nt, Artificial Sequence
  Synthetic oligonucleotide
aaguuaaagaauaugucuu

SEQ ID NO: 15351 - RNA, 19 nt, Artificial Sequence
  Synthetic oligonucleotide
aguuaaagaauaugucuug

SEQ ID NO: 15352 - RNA, 19 nt, Artificial Sequence
  Synthetic oligonucleotide
guuaaagaauaugucuugc

SEQ ID NO: 15353 - RNA, 19 nt, Artificial Sequence
  Synthetic oligonucleotide
aagaauaugucuugccaca

SEQ ID NO: 15354 - RNA, 19 nt, Artificial Sequence
  Synthetic oligonucleotide
agaauaugucuugccacau

SEQ ID NO: 15355 - RNA, 19 nt, Artificial Sequence
  Synthetic oligonucleotide
gaauaugucuugccacauu

SEQ ID NO: 15356 - RNA, 19 nt, Artificial Sequence
  Synthetic oligonucleotide
aauaugucuugccacauuu

SEQ ID NO: 15357 - RNA, 19 nt, Artificial Sequence
  Synthetic oligonucleotide
auaugucuugccacauuuu

SEQ ID NO: 15358 - RNA, 19 nt, Artificial Sequence
  Synthetic oligonucleotide
uaugucuugccacauuuuu

SEQ ID NO: 15359 - RNA, 19 nt, Artificial Sequence
  Synthetic oligonucleotide
augucuugccacauuuuuc

SEQ ID NO: 15360 - RNA, 19 nt, Artificial Sequence
  Synthetic oligonucleotide
ugucuugccacauuuuucu

SEQ ID NO: 15361 - RNA, 19 nt, Artificial Sequence
  Synthetic oligonucleotide
gucuugccacauuuuucug

SEQ ID NO: 15362 - RNA, 19 nt, Artificial Sequence
  Synthetic oligonucleotide
ucuugccacauuuuucugu

SEQ ID NO: 15363 - RNA, 19 nt, Artificial Sequence
  Synthetic oligonucleotide
cuugccacauuuuucuguc

SEQ ID NO: 15364 - RNA, 19 nt, Artificial Sequence
  Synthetic oligonucleotide
uugccacauuuuucugucu

SEQ ID NO: 15365 - RNA, 19 nt, Artificial Sequence
  Synthetic oligonucleotide
ugccacauuuuucugucuc

SEQ ID NO: 15366 - RNA, 19 nt, Artificial Sequence
  Synthetic oligonucleotide
gccacauuuuucugucuca

SEQ ID NO: 15367 - RNA, 19 nt, Artificial Sequence
  Synthetic oligonucleotide
gaacuuuaagaauuuugaa

SEQ ID NO: 15368 - RNA, 19 nt, Artificial Sequence
  Synthetic oligonucleotide
aacuuuaagaauuuugaaa

SEQ ID NO: 15369 - RNA, 19 nt, Artificial Sequence
  Synthetic oligonucleotide
acuuuaagaauuuugaaau

SEQ ID NO: 15370 - RNA, 19 nt, Artificial Sequence
  Synthetic oligonucleotide
uuuaagaauuuugaaauua

SEQ ID NO: 15371 - RNA, 19 nt, Artificial Sequence
  Synthetic oligonucleotide
uuaagaauuuugaaauuac

SEQ ID NO: 15372 - RNA, 19 nt, Artificial Sequence
  Synthetic oligonucleotide
uaagaauuuugaaauuacu

SEQ ID NO: 15373 - RNA, 19 nt, Artificial Sequence
  Synthetic oligonucleotide
aagaauuuugaaauuacua

SEQ ID NO: 15374 - RNA, 19 nt, Artificial Sequence
  Synthetic oligonucleotide
agaauuuugaaauuacuau

SEQ ID NO: 15375 - RNA, 19 nt, Artificial Sequence
  Synthetic oligonucleotide
uuuugaaauuacuauaaaa

SEQ ID NO: 15376 - RNA, 19 nt, Artificial Sequence
  Synthetic oligonucleotide
uuugaaauuacuauaaaag

SEQ ID NO: 15377 - RNA, 19 nt, Artificial Sequence
  Synthetic oligonucleotide
aaauuacuauaaaagcaag

SEQ ID NO: 15378 - RNA, 19 nt, Artificial Sequence
  Synthetic oligonucleotide
aauuacuauaaaagcaaga

SEQ ID NO: 15379 - RNA, 19 nt, Artificial Sequence
  Synthetic oligonucleotide
auuacuauaaaagcaagau

SEQ ID NO: 15380 - RNA, 19 nt, Artificial Sequence
  Synthetic oligonucleotide
uuacuauaaaagcaagaua

SEQ ID NO: 15381 - RNA, 19 nt, Artificial Sequence
  Synthetic oligonucleotide
uacuauaaaagcaagauau

SEQ ID NO: 15382 - RNA, 19 nt, Artificial Sequence
  Synthetic oligonucleotide
acuauaaaagcaagauauu

SEQ ID NO: 15383 - RNA, 19 nt, Artificial Sequence
  Synthetic oligonucleotide
cuauaaaagcaagauauuu

SEQ ID NO: 15384 - RNA, 19 nt, Artificial Sequence
  Synthetic oligonucleotide
uauaaaagcaagauauuuu

SEQ ID NO: 15385 - RNA, 19 nt, Artificial Sequence
  Synthetic oligonucleotide
auaaaagcaagauauuuuu

SEQ ID NO: 15386 - RNA, 19 nt, Artificial Sequence
  Synthetic oligonucleotide
uaaaagcaagauauuuuua

SEQ ID NO: 15387 - RNA, 19 nt, Artificial Sequence
  Synthetic oligonucleotide
aaaagcaagauauuuuuau

SEQ ID NO: 15388 - RNA, 19 nt, Artificial Sequence
  Synthetic oligonucleotide
auauuuuuauaauaaagua

SEQ ID NO: 15389 - RNA, 19 nt, Artificial Sequence
  Synthetic oligonucleotide
uauuuuuauaauaaaguag

SEQ ID NO: 15390 - RNA, 19 nt, Artificial Sequence
  Synthetic oligonucleotide
auuuuuauaauaaaguagu

SEQ ID NO: 15391 - RNA, 19 nt, Artificial Sequence
  Synthetic oligonucleotide
uuuuuauaauaaaguaguc

SEQ ID NO: 15392 - RNA, 19 nt, Artificial Sequence
  Synthetic oligonucleotide
uuuuauaauaaaguaguca

SEQ ID NO: 15393 - RNA, 19 nt, Artificial Sequence
  Synthetic oligonucleotide
uuuauaauaaaguagucac

SEQ ID NO: 15394 - RNA, 19 nt, Artificial Sequence
  Synthetic oligonucleotide
uuauaauaaaguagucacu

SEQ ID NO: 15395 - RNA, 19 nt, Artificial Sequence
  Synthetic oligonucleotide
uauaauaaaguagucacug

SEQ ID NO: 15396 - RNA, 19 nt, Artificial Sequence
  Synthetic oligonucleotide
auaauaaaguagucacuga

SEQ ID NO: 15397 - RNA, 19 nt, Artificial Sequence
  Synthetic oligonucleotide
uaauaaaguagucacugag

SEQ ID NO: 15398 - RNA, 19 nt, Artificial Sequence
  Synthetic oligonucleotide
aauaaaguagucacugagg

SEQ ID NO: 15399 - RNA, 19 nt, Artificial Sequence
  Synthetic oligonucleotide
auaaaguagucacugaggc

SEQ ID NO: 15400 - RNA, 19 nt, Artificial Sequence
  Synthetic oligonucleotide
uaaaguagucacugaggcu

SEQ ID NO: 15401 - RNA, 19 nt, Artificial Sequence
  Synthetic oligonucleotide
aaaguagucacugaggcug

SEQ ID NO: 15402 - RNA, 19 nt, Artificial Sequence
  Synthetic oligonucleotide
aaguagucacugaggcuga

SEQ ID NO: 15403 - RNA, 19 nt, Artificial Sequence
  Synthetic oligonucleotide
guuuauaucacauuuggaa

SEQ ID NO: 15404 - RNA, 19 nt, Artificial Sequence
  Synthetic oligonucleotide
uuuauaucacauuuggaau

SEQ ID NO: 15405 - RNA, 19 nt, Artificial Sequence
  Synthetic oligonucleotide
uuauaucacauuuggaaua

SEQ ID NO: 15406 - RNA, 19 nt, Artificial Sequence
  Synthetic oligonucleotide
uauaucacauuuggaauaa

SEQ ID NO: 15407 - RNA, 19 nt, Artificial Sequence
  Synthetic oligonucleotide
auaucacauuuggaauaag

SEQ ID NO: 15408 - RNA, 19 nt, Artificial Sequence
  Synthetic oligonucleotide
uaucacauuuggaauaaga

SEQ ID NO: 15409 - RNA, 19 nt, Artificial Sequence
  Synthetic oligonucleotide
aucacauuuggaauaagag

SEQ ID NO: 15410 - RNA, 19 nt, Artificial Sequence
  Synthetic oligonucleotide
ucacauuuggaauaagaga

SEQ ID NO: 15411 - RNA, 19 nt, Artificial Sequence
  Synthetic oligonucleotide
cacauuuggaauaagagaa

SEQ ID NO: 15412 - RNA, 19 nt, Artificial Sequence
  Synthetic oligonucleotide
acauuuggaauaagagaag

SEQ ID NO: 15413 - RNA, 19 nt, Artificial Sequence
  Synthetic oligonucleotide
cauuuggaauaagagaaga

SEQ ID NO: 15414 - RNA, 19 nt, Artificial Sequence
  Synthetic oligonucleotide
auuuggaauaagagaagac

SEQ ID NO: 15415 - RNA, 19 nt, Artificial Sequence
  Synthetic oligonucleotide
uuuggaauaagagaagacu

SEQ ID NO: 15416 - RNA, 19 nt, Artificial Sequence
  Synthetic oligonucleotide
uuggaauaagagaagacuu

SEQ ID NO: 15417 - RNA, 19 nt, Artificial Sequence
  Synthetic oligonucleotide
uggaauaagagaagacuua

SEQ ID NO: 15418 - RNA, 19 nt, Artificial Sequence
  Synthetic oligonucleotide
ggaauaagagaagacuuaa

SEQ ID NO: 15419 - RNA, 19 nt, Artificial Sequence
  Synthetic oligonucleotide
gaauaagagaagacuuaaa

SEQ ID NO: 15420 - RNA, 19 nt, Artificial Sequence
  Synthetic oligonucleotide
aauaagagaagacuuaaaa

SEQ ID NO: 15421 - RNA, 19 nt, Artificial Sequence
  Synthetic oligonucleotide
auaagagaagacuuaaaag

SEQ ID NO: 15422 - RNA, 19 nt, Artificial Sequence
  Synthetic oligonucleotide
uaagagaagacuuaaaaga

SEQ ID NO: 15423 - RNA, 19 nt, Artificial Sequence
  Synthetic oligonucleotide
aagagaagacuuaaaagau

SEQ ID NO: 15424 - RNA, 19 nt, Artificial Sequence
  Synthetic oligonucleotide
agagaagacuuaaaagaug

SEQ ID NO: 15425 - RNA, 19 nt, Artificial Sequence
  Synthetic oligonucleotide
gagaagacuuaaaagauga

SEQ ID NO: 15426 - RNA, 19 nt, Artificial Sequence
  Synthetic oligonucleotide
agaagacuuaaaagaugau

SEQ ID NO: 15427 - RNA, 19 nt, Artificial Sequence
  Synthetic oligonucleotide
gaagacuuaaaagaugauc

SEQ ID NO: 15428 - RNA, 19 nt, Artificial Sequence
  Synthetic oligonucleotide
aagacuuaaaagaugauca

SEQ ID NO: 15429 - RNA, 19 nt, Artificial Sequence
  Synthetic oligonucleotide
agacuuaaaagaugaucaa

SEQ ID NO: 15430 - RNA, 19 nt, Artificial Sequence
  Synthetic oligonucleotide
gacuuaaaagaugaucaaa

SEQ ID NO: 15431 - RNA, 19 nt, Artificial Sequence
  Synthetic oligonucleotide
acuuaaaagaugaucaaaa

SEQ ID NO: 15432 - RNA, 19 nt, Artificial Sequence
  Synthetic oligonucleotide
cuuaaaagaugaucaaaaa

SEQ ID NO: 15433 - RNA, 19 nt, Artificial Sequence
  Synthetic oligonucleotide
uuaaaagaugaucaaaaag

SEQ ID NO: 15434 - RNA, 19 nt, Artificial Sequence
  Synthetic oligonucleotide
uaaaagaugaucaaaaaga

SEQ ID NO: 15435 - RNA, 19 nt, Artificial Sequence
  Synthetic oligonucleotide
aaaagaugaucaaaaagaa

SEQ ID NO: 15436 - RNA, 19 nt, Artificial Sequence
  Synthetic oligonucleotide
aaagaugaucaaaaagaaa

SEQ ID NO: 15437 - RNA, 19 nt, Artificial Sequence
  Synthetic oligonucleotide
aagaugaucaaaaagaaau

SEQ ID NO: 15438 - RNA, 19 nt, Artificial Sequence
  Synthetic oligonucleotide
agaugaucaaaaagaaaug

SEQ ID NO: 15439 - RNA, 19 nt, Artificial Sequence
  Synthetic oligonucleotide
gaugaucaaaaagaaauga

SEQ ID NO: 15440 - RNA, 19 nt, Artificial Sequence
  Synthetic oligonucleotide
augaucaaaaagaaaugau

SEQ ID NO: 15441 - RNA, 19 nt, Artificial Sequence
  Synthetic oligonucleotide
ugaucaaaaagaaaugaug

SEQ ID NO: 15442 - RNA, 19 nt, Artificial Sequence
  Synthetic oligonucleotide
gaucaaaaagaaaugaugc

SEQ ID NO: 15443 - RNA, 19 nt, Artificial Sequence
  Synthetic oligonucleotide
aucaaaaagaaaugaugca

SEQ ID NO: 15444 - RNA, 19 nt, Artificial Sequence
  Synthetic oligonucleotide
ucaaaaagaaaugaugcaa

SEQ ID NO: 15445 - RNA, 19 nt, Artificial Sequence
  Synthetic oligonucleotide
caaaaagaaaugaugcaaa

SEQ ID NO: 15446 - RNA, 19 nt, Artificial Sequence
  Synthetic oligonucleotide
aaaaagaaaugaugcaaac

SEQ ID NO: 15447 - RNA, 19 nt, Artificial Sequence
  Synthetic oligonucleotide
aaaagaaaugaugcaaaca

SEQ ID NO: 15448 - RNA, 19 nt, Artificial Sequence
  Synthetic oligonucleotide
aaagaaaugaugcaaacag

SEQ ID NO: 15449 - RNA, 19 nt, Artificial Sequence
  Synthetic oligonucleotide
aagaaaugaugcaaacagc

SEQ ID NO: 15450 - RNA, 19 nt, Artificial Sequence
  Synthetic oligonucleotide
agaaaugaugcaaacagca

SEQ ID NO: 15451 - RNA, 19 nt, Artificial Sequence
  Synthetic oligonucleotide
gaaaugaugcaaacagcaa

SEQ ID NO: 15452 - RNA, 19 nt, Artificial Sequence
  Synthetic oligonucleotide
aaaugaugcaaacagcaau

SEQ ID NO: 15453 - RNA, 19 nt, Artificial Sequence
  Synthetic oligonucleotide
aaugaugcaaacagcaaug

SEQ ID NO: 15454 - RNA, 19 nt, Artificial Sequence
  Synthetic oligonucleotide
augaugcaaacagcaaugc

SEQ ID NO: 15455 - RNA, 19 nt, Artificial Sequence
  Synthetic oligonucleotide
ugaugcaaacagcaaugca

SEQ ID NO: 15456 - RNA, 19 nt, Artificial Sequence
  Synthetic oligonucleotide
auguugauaaauggaauug

SEQ ID NO: 15457 - RNA, 19 nt, Artificial Sequence
  Synthetic oligonucleotide
ugauaaauggaauugcuca

SEQ ID NO: 15458 - RNA, 19 nt, Artificial Sequence
  Synthetic oligonucleotide
gauaaauggaauugcucaa

SEQ ID NO: 15459 - RNA, 19 nt, Artificial Sequence
  Synthetic oligonucleotide
uaaauggaauugcucaagu

SEQ ID NO: 15460 - RNA, 19 nt, Artificial Sequence
  Synthetic oligonucleotide
aaauggaauugcucaaguc

SEQ ID NO: 15461 - RNA, 19 nt, Artificial Sequence
  Synthetic oligonucleotide
aauggaauugcucaaguca

SEQ ID NO: 15462 - RNA, 19 nt, Artificial Sequence
  Synthetic oligonucleotide
uggaauugcucaagucaca

SEQ ID NO: 15463 - RNA, 19 nt, Artificial Sequence
  Synthetic oligonucleotide
ggaauugcucaagucacau

SEQ ID NO: 15464 - RNA, 19 nt, Artificial Sequence
  Synthetic oligonucleotide
gaauugcucaagucacauu

SEQ ID NO: 15465 - RNA, 19 nt, Artificial Sequence
  Synthetic oligonucleotide
aauugcucaagucacauuu

SEQ ID NO: 15466 - RNA, 19 nt, Artificial Sequence
  Synthetic oligonucleotide
auugcucaagucacauuug

SEQ ID NO: 15467 - RNA, 19 nt, Artificial Sequence
  Synthetic oligonucleotide
uugcucaagucacauuuga

SEQ ID NO: 15468 - RNA, 19 nt, Artificial Sequence
  Synthetic oligonucleotide
ugcucaagucacauuugau

SEQ ID NO: 15469 - RNA, 19 nt, Artificial Sequence
  Synthetic oligonucleotide
gcucaagucacauuugauu

SEQ ID NO: 15470 - RNA, 19 nt, Artificial Sequence
  Synthetic oligonucleotide
ucaagucacauuugauucu

SEQ ID NO: 15471 - RNA, 19 nt, Artificial Sequence
  Synthetic oligonucleotide
gucacauuugauucugaaa

SEQ ID NO: 15472 - RNA, 19 nt, Artificial Sequence
  Synthetic oligonucleotide
ucacauuugauucugaaac

SEQ ID NO: 15473 - RNA, 19 nt, Artificial Sequence
  Synthetic oligonucleotide
cacauuugauucugaaaca

SEQ ID NO: 15474 - RNA, 19 nt, Artificial Sequence
  Synthetic oligonucleotide
acauuugauucugaaacag

SEQ ID NO: 15475 - RNA, 19 nt, Artificial Sequence
  Synthetic oligonucleotide
auuugauucugaaacagca

SEQ ID NO: 15476 - RNA, 19 nt, Artificial Sequence
  Synthetic oligonucleotide
ugauucugaaacagcaguc

SEQ ID NO: 15477 - RNA, 19 nt, Artificial Sequence
  Synthetic oligonucleotide
gauucugaaacagcaguca

SEQ ID NO: 15478 - RNA, 19 nt, Artificial Sequence
  Synthetic oligonucleotide
auucugaaacagcagucaa

SEQ ID NO: 15479 - RNA, 19 nt, Artificial Sequence
  Synthetic oligonucleotide
uucugaaacagcagucaaa

SEQ ID NO: 15480 - RNA, 19 nt, Artificial Sequence
  Synthetic oligonucleotide
ucugaaacagcagucaaag

SEQ ID NO: 15481 - RNA, 19 nt, Artificial Sequence
  Synthetic oligonucleotide
cugaaacagcagucaaaga

SEQ ID NO: 15482 - RNA, 19 nt, Artificial Sequence
  Synthetic oligonucleotide
ugaaacagcagucaaagaa

SEQ ID NO: 15483 - RNA, 19 nt, Artificial Sequence
  Synthetic oligonucleotide
gaaacagcagucaaagaac

SEQ ID NO: 15484 - RNA, 19 nt, Artificial Sequence
  Synthetic oligonucleotide
aaacagcagucaaagaacu

SEQ ID NO: 15485 - RNA, 19 nt, Artificial Sequence
  Synthetic oligonucleotide
aacagcagucaaagaacug

SEQ ID NO: 15486 - RNA, 19 nt, Artificial Sequence
  Synthetic oligonucleotide
acagcagucaaagaacugu

SEQ ID NO: 15487 - RNA, 19 nt, Artificial Sequence
  Synthetic oligonucleotide
agcagucaaagaacuguca

SEQ ID NO: 15488 - RNA, 19 nt, Artificial Sequence
  Synthetic oligonucleotide
cagucaaagaacugucaua

SEQ ID NO: 15489 - RNA, 19 nt, Artificial Sequence
  Synthetic oligonucleotide
agucaaagaacugucauac

SEQ ID NO: 15490 - RNA, 19 nt, Artificial Sequence
  Synthetic oligonucleotide
ucaaagaacugucauacua

SEQ ID NO: 15491 - RNA, 19 nt, Artificial Sequence
  Synthetic oligonucleotide
caaagaacugucauacuac

SEQ ID NO: 15492 - RNA, 19 nt, Artificial Sequence
  Synthetic oligonucleotide
aaagaacugucauacuaca

SEQ ID NO: 15493 - RNA, 19 nt, Artificial Sequence
  Synthetic oligonucleotide
gaacugucauacuacaguu

SEQ ID NO: 15494 - RNA, 19 nt, Artificial Sequence
  Synthetic oligonucleotide
acugucauacuacaguuua

SEQ ID NO: 15495 - RNA, 19 nt, Artificial Sequence
  Synthetic oligonucleotide
cugucauacuacaguuuag

SEQ ID NO: 15496 - RNA, 19 nt, Artificial Sequence
  Synthetic oligonucleotide
ugucauacuacaguuuaga

SEQ ID NO: 15497 - RNA, 19 nt, Artificial Sequence
  Synthetic oligonucleotide
gucauacuacaguuuagaa

SEQ ID NO: 15498 - RNA, 19 nt, Artificial Sequence
  Synthetic oligonucleotide
ucauacuacaguuuagaag

SEQ ID NO: 15499 - RNA, 19 nt, Artificial Sequence
  Synthetic oligonucleotide
cauacuacaguuuagaaga

SEQ ID NO: 15500 - RNA, 19 nt, Artificial Sequence
  Synthetic oligonucleotide
auacuacaguuuagaagau

SEQ ID NO: 15501 - RNA, 19 nt, Artificial Sequence
  Synthetic oligonucleotide
uacuacaguuuagaagauu

SEQ ID NO: 15502 - RNA, 19 nt, Artificial Sequence
  Synthetic oligonucleotide
acuacaguuuagaagauuu

SEQ ID NO: 15503 - RNA, 19 nt, Artificial Sequence
  Synthetic oligonucleotide
cuacaguuuagaagauuua

SEQ ID NO: 15504 - RNA, 19 nt, Artificial Sequence
  Synthetic oligonucleotide
uacaguuuagaagauuuaa

SEQ ID NO: 15505 - RNA, 19 nt, Artificial Sequence
  Synthetic oligonucleotide
acaguuuagaagauuuaaa

SEQ ID NO: 15506 - RNA, 19 nt, Artificial Sequence
  Synthetic oligonucleotide
caguuuagaagauuuaaac

SEQ ID NO: 15507 - RNA, 19 nt, Artificial Sequence
  Synthetic oligonucleotide
aguuuagaagauuuaaaca

SEQ ID NO: 15508 - RNA, 19 nt, Artificial Sequence
  Synthetic oligonucleotide
guuuagaagauuuaaacaa

SEQ ID NO: 15509 - RNA, 19 nt, Artificial Sequence
  Synthetic oligonucleotide
uuuagaagauuuaaacaac

SEQ ID NO: 15510 - RNA, 19 nt, Artificial Sequence
  Synthetic oligonucleotide
uuagaagauuuaaacaaca

SEQ ID NO: 15511 - RNA, 19 nt, Artificial Sequence
  Synthetic oligonucleotide
uagaagauuuaaacaacaa

SEQ ID NO: 15512 - RNA, 19 nt, Artificial Sequence
  Synthetic oligonucleotide
agaagauuuaaacaacaag

SEQ ID NO: 15513 - RNA, 19 nt, Artificial Sequence
  Synthetic oligonucleotide
gaagauuuaaacaacaagu

SEQ ID NO: 15514 - RNA, 19 nt, Artificial Sequence
  Synthetic oligonucleotide
aagauuuaaacaacaagua

SEQ ID NO: 15515 - RNA, 19 nt, Artificial Sequence
  Synthetic oligonucleotide
agauuuaaacaacaaguac

SEQ ID NO: 15516 - RNA, 19 nt, Artificial Sequence
  Synthetic oligonucleotide
gauuuaaacaacaaguacc

SEQ ID NO: 15517 - RNA, 19 nt, Artificial Sequence
  Synthetic oligonucleotide
auuuaaacaacaaguaccu

SEQ ID NO: 15518 - RNA, 19 nt, Artificial Sequence
  Synthetic oligonucleotide
uuuaaacaacaaguaccuu

SEQ ID NO: 15519 - RNA, 19 nt, Artificial Sequence
  Synthetic oligonucleotide
uaccuuuauauugcuguaa

SEQ ID NO: 15520 - RNA, 19 nt, Artificial Sequence
  Synthetic oligonucleotide
ccuuuauauugcuguaaca

SEQ ID NO: 15521 - RNA, 19 nt, Artificial Sequence
  Synthetic oligonucleotide
cuuuauauugcuguaacag

SEQ ID NO: 15522 - RNA, 19 nt, Artificial Sequence
  Synthetic oligonucleotide
uuuauauugcuguaacagu

SEQ ID NO: 15523 - RNA, 19 nt, Artificial Sequence
  Synthetic oligonucleotide
uuauauugcuguaacaguc

SEQ ID NO: 15524 - RNA, 19 nt, Artificial Sequence
  Synthetic oligonucleotide
uauauugcuguaacaguca

SEQ ID NO: 15525 - RNA, 19 nt, Artificial Sequence
  Synthetic oligonucleotide
auauugcuguaacagucau

SEQ ID NO: 15526 - RNA, 19 nt, Artificial Sequence
  Synthetic oligonucleotide
uauugcuguaacagucaua

SEQ ID NO: 15527 - RNA, 19 nt, Artificial Sequence
  Synthetic oligonucleotide
auugcuguaacagucauag

SEQ ID NO: 15528 - RNA, 19 nt, Artificial Sequence
  Synthetic oligonucleotide
uugcuguaacagucauaga

SEQ ID NO: 15529 - RNA, 19 nt, Artificial Sequence
  Synthetic oligonucleotide
ugcuguaacagucauagag

SEQ ID NO: 15530 - RNA, 19 nt, Artificial Sequence
  Synthetic oligonucleotide
gcuguaacagucauagagu

SEQ ID NO: 15531 - RNA, 19 nt, Artificial Sequence
  Synthetic oligonucleotide
cuguaacagucauagaguc

SEQ ID NO: 15532 - RNA, 19 nt, Artificial Sequence
  Synthetic oligonucleotide
uguaacagucauagagucu

SEQ ID NO: 15533 - RNA, 19 nt, Artificial Sequence
  Synthetic oligonucleotide
guaacagucauagagucua

SEQ ID NO: 15534 - RNA, 19 nt, Artificial Sequence
  Synthetic oligonucleotide
uaacagucauagagucuac

SEQ ID NO: 15535 - RNA, 19 nt, Artificial Sequence
  Synthetic oligonucleotide
aacagucauagagucuaca

SEQ ID NO: 15536 - RNA, 19 nt, Artificial Sequence
  Synthetic oligonucleotide
acagucauagagucuacag

SEQ ID NO: 15537 - RNA, 19 nt, Artificial Sequence
  Synthetic oligonucleotide
cagucauagagucuacagg

SEQ ID NO: 15538 - RNA, 19 nt, Artificial Sequence
  Synthetic oligonucleotide
agucauagagucuacaggu

SEQ ID NO: 15539 - RNA, 19 nt, Artificial Sequence
  Synthetic oligonucleotide
gucauagagucuacaggug

SEQ ID NO: 15540 - RNA, 19 nt, Artificial Sequence
  Synthetic oligonucleotide
ucauagagucuacaggugg

SEQ ID NO: 15541 - RNA, 19 nt, Artificial Sequence
  Synthetic oligonucleotide
cauagagucuacaggugga

SEQ ID NO: 15542 - RNA, 19 nt, Artificial Sequence
  Synthetic oligonucleotide
auagagucuacagguggau

SEQ ID NO: 15543 - RNA, 19 nt, Artificial Sequence
  Synthetic oligonucleotide
uagagucuacagguggauu

SEQ ID NO: 15544 - RNA, 19 nt, Artificial Sequence
  Synthetic oligonucleotide
agagucuacagguggauuu

SEQ ID NO: 15545 - RNA, 19 nt, Artificial Sequence
  Synthetic oligonucleotide
gagucuacagguggauuuu

SEQ ID NO: 15546 - RNA, 19 nt, Artificial Sequence
  Synthetic oligonucleotide
agucuacagguggauuuuc

SEQ ID NO: 15547 - RNA, 19 nt, Artificial Sequence
  Synthetic oligonucleotide
gucuacagguggauuuucu

SEQ ID NO: 15548 - RNA, 19 nt, Artificial Sequence
  Synthetic oligonucleotide
ucuacagguggauuuucug

SEQ ID NO: 15549 - RNA, 19 nt, Artificial Sequence
  Synthetic oligonucleotide
cuacagguggauuuucuga

SEQ ID NO: 15550 - RNA, 19 nt, Artificial Sequence
  Synthetic oligonucleotide
uacagguggauuuucugaa

SEQ ID NO: 15551 - RNA, 19 nt, Artificial Sequence
  Synthetic oligonucleotide
acagguggauuuucugaag

SEQ ID NO: 15552 - RNA, 19 nt, Artificial Sequence
  Synthetic oligonucleotide
cagguggauuuucugaaga

SEQ ID NO: 15553 - RNA, 19 nt, Artificial Sequence
  Synthetic oligonucleotide
agguggauuuucugaagag

SEQ ID NO: 15554 - RNA, 19 nt, Artificial Sequence
  Synthetic oligonucleotide
gguggauuuucugaagagg

SEQ ID NO: 15555 - RNA, 19 nt, Artificial Sequence
  Synthetic oligonucleotide
guggauuuucugaagaggc

SEQ ID NO: 15556 - RNA, 19 nt, Artificial Sequence
  Synthetic oligonucleotide
uggauuuucugaagaggca

SEQ ID NO: 15557 - RNA, 19 nt, Artificial Sequence
  Synthetic oligonucleotide
ggauuuucugaagaggcag

SEQ ID NO: 15558 - RNA, 19 nt, Artificial Sequence
  Synthetic oligonucleotide
gauuuucugaagaggcaga

SEQ ID NO: 15559 - RNA, 19 nt, Artificial Sequence
  Synthetic oligonucleotide
auuuucugaagaggcagaa

SEQ ID NO: 15560 - RNA, 19 nt, Artificial Sequence
  Synthetic oligonucleotide
uuuucugaagaggcagaaa

SEQ ID NO: 15561 - RNA, 19 nt, Artificial Sequence
  Synthetic oligonucleotide
uuucugaagaggcagaaau

SEQ ID NO: 15562 - RNA, 19 nt, Artificial Sequence
  Synthetic oligonucleotide
uucugaagaggcagaaaua

SEQ ID NO: 15563 - RNA, 19 nt, Artificial Sequence
  Synthetic oligonucleotide
ucugaagaggcagaaauac

SEQ ID NO: 15564 - RNA, 19 nt, Artificial Sequence
  Synthetic oligonucleotide
cugaagaggcagaaauacc

SEQ ID NO: 15565 - RNA, 19 nt, Artificial Sequence
  Synthetic oligonucleotide
ugaagaggcagaaauaccu

SEQ ID NO: 15566 - RNA, 19 nt, Artificial Sequence
  Synthetic oligonucleotide
gaagaggcagaaauaccug

SEQ ID NO: 15567 - RNA, 19 nt, Artificial Sequence
  Synthetic oligonucleotide
aagaggcagaaauaccugg

SEQ ID NO: 15568 - RNA, 19 nt, Artificial Sequence
  Synthetic oligonucleotide
agaggcagaaauaccuggc

SEQ ID NO: 15569 - RNA, 19 nt, Artificial Sequence
  Synthetic oligonucleotide
gaggcagaaauaccuggca

SEQ ID NO: 15570 - RNA, 19 nt, Artificial Sequence
  Synthetic oligonucleotide
aggcagaaauaccuggcau

SEQ ID NO: 15571 - RNA, 19 nt, Artificial Sequence
  Synthetic oligonucleotide
ggcagaaauaccuggcauc

SEQ ID NO: 15572 - RNA, 19 nt, Artificial Sequence
  Synthetic oligonucleotide
gcagaaauaccuggcauca

SEQ ID NO: 15573 - RNA, 19 nt, Artificial Sequence
  Synthetic oligonucleotide
cagaaauaccuggcaucaa

SEQ ID NO: 15574 - RNA, 19 nt, Artificial Sequence
  Synthetic oligonucleotide
agaaauaccuggcaucaaa

SEQ ID NO: 15575 - RNA, 19 nt, Artificial Sequence
  Synthetic oligonucleotide
gaaauaccuggcaucaaau

SEQ ID NO: 15576 - RNA, 19 nt, Artificial Sequence
  Synthetic oligonucleotide
aaauaccuggcaucaaaua

SEQ ID NO: 15577 - RNA, 19 nt, Artificial Sequence
  Synthetic oligonucleotide
aauaccuggcaucaaauau

SEQ ID NO: 15578 - RNA, 19 nt, Artificial Sequence
  Synthetic oligonucleotide
auaccuggcaucaaauaug

SEQ ID NO: 15579 - RNA, 19 nt, Artificial Sequence
  Synthetic oligonucleotide
uaccuggcaucaaauaugu

SEQ ID NO: 15580 - RNA, 19 nt, Artificial Sequence
  Synthetic oligonucleotide
accuggcaucaaauauguc

SEQ ID NO: 15581 - RNA, 19 nt, Artificial Sequence
  Synthetic oligonucleotide
ccuggcaucaaauaugucc

SEQ ID NO: 15582 - RNA, 19 nt, Artificial Sequence
  Synthetic oligonucleotide
cuggcaucaaauauguccu

SEQ ID NO: 15583 - RNA, 19 nt, Artificial Sequence
  Synthetic oligonucleotide
uggcaucaaauauguccuc

SEQ ID NO: 15584 - RNA, 19 nt, Artificial Sequence
  Synthetic oligonucleotide
ggcaucaaauauguccucu

SEQ ID NO: 15585 - RNA, 19 nt, Artificial Sequence
  Synthetic oligonucleotide
gcaucaaauauguccucuc

SEQ ID NO: 15586 - RNA, 19 nt, Artificial Sequence
  Synthetic oligonucleotide
caucaaauauguccucucu

SEQ ID NO: 15587 - RNA, 19 nt, Artificial Sequence
  Synthetic oligonucleotide
aucaaauauguccucucuc

SEQ ID NO: 15588 - RNA, 19 nt, Artificial Sequence
  Synthetic oligonucleotide
caaauauguccucucuccc

SEQ ID NO: 15589 - RNA, 19 nt, Artificial Sequence
  Synthetic oligonucleotide
aaauauguccucucucccu

SEQ ID NO: 15590 - RNA, 19 nt, Artificial Sequence
  Synthetic oligonucleotide
aauauguccucucucccua

SEQ ID NO: 15591 - RNA, 19 nt, Artificial Sequence
  Synthetic oligonucleotide
auauguccucucucccuac

SEQ ID NO: 15592 - RNA, 19 nt, Artificial Sequence
  Synthetic oligonucleotide
uauguccucucucccuaca

SEQ ID NO: 15593 - RNA, 19 nt, Artificial Sequence
  Synthetic oligonucleotide
auguccucucucccuacaa

SEQ ID NO: 15594 - RNA, 19 nt, Artificial Sequence
  Synthetic oligonucleotide
uguccucucucccuacaaa

SEQ ID NO: 15595 - RNA, 19 nt, Artificial Sequence
  Synthetic oligonucleotide
guccucucucccuacaaac

SEQ ID NO: 15596 - RNA, 19 nt, Artificial Sequence
  Synthetic oligonucleotide
uccucucucccuacaaacu

SEQ ID NO: 15597 - RNA, 19 nt, Artificial Sequence
  Synthetic oligonucleotide
ccucucucccuacaaacug

SEQ ID NO: 15598 - RNA, 19 nt, Artificial Sequence
  Synthetic oligonucleotide
cucucucccuacaaacuga

SEQ ID NO: 15599 - RNA, 19 nt, Artificial Sequence
  Synthetic oligonucleotide
ucucucccuacaaacugaa

SEQ ID NO: 15600 - RNA, 19 nt, Artificial Sequence
  Synthetic oligonucleotide
cucucccuacaaacugaau

SEQ ID NO: 15601 - RNA, 19 nt, Artificial Sequence
  Synthetic oligonucleotide
ucucccuacaaacugaauu

SEQ ID NO: 15602 - RNA, 19 nt, Artificial Sequence
  Synthetic oligonucleotide
cucccuacaaacugaauuu

SEQ ID NO: 15603 - RNA, 19 nt, Artificial Sequence
  Synthetic oligonucleotide
ucccuacaaacugaauuug

SEQ ID NO: 15604 - RNA, 19 nt, Artificial Sequence
  Synthetic oligonucleotide
ccuacaaacugaauuuggu

SEQ ID NO: 15605 - RNA, 19 nt, Artificial Sequence
  Synthetic oligonucleotide
cuacaaacugaauuugguu

SEQ ID NO: 15606 - RNA, 19 nt, Artificial Sequence
  Synthetic oligonucleotide
uacaaacugaauuugguug

SEQ ID NO: 15607 - RNA, 19 nt, Artificial Sequence
  Synthetic oligonucleotide
aaacugaauuugguugcua

SEQ ID NO: 15608 - RNA, 19 nt, Artificial Sequence
  Synthetic oligonucleotide
aacugaauuugguugcuac

SEQ ID NO: 15609 - RNA, 19 nt, Artificial Sequence
  Synthetic oligonucleotide
acugaauuugguugcuacu

SEQ ID NO: 15610 - RNA, 19 nt, Artificial Sequence
  Synthetic oligonucleotide
cugaauuugguugcuacuc

SEQ ID NO: 15611 - RNA, 19 nt, Artificial Sequence
  Synthetic oligonucleotide
ugaauuugguugcuacucc

SEQ ID NO: 15612 - RNA, 19 nt, Artificial Sequence
  Synthetic oligonucleotide
gaauuugguugcuacuccu

SEQ ID NO: 15613 - RNA, 19 nt, Artificial Sequence
  Synthetic oligonucleotide
aauuugguugcuacuccuc

SEQ ID NO: 15614 - RNA, 19 nt, Artificial Sequence
  Synthetic oligonucleotide
auuugguugcuacuccucu

SEQ ID NO: 15615 - RNA, 19 nt, Artificial Sequence
  Synthetic oligonucleotide
uuugguugcuacuccucuu

SEQ ID NO: 15616 - RNA, 19 nt, Artificial Sequence
  Synthetic oligonucleotide
uugguugcuacuccucuuu

SEQ ID NO: 15617 - RNA, 19 nt, Artificial Sequence
  Synthetic oligonucleotide
ugguugcuacuccucuuuu

SEQ ID NO: 15618 - RNA, 19 nt, Artificial Sequence
  Synthetic oligonucleotide
gguugcuacuccucuuuuc

SEQ ID NO: 15619 - RNA, 19 nt, Artificial Sequence
  Synthetic oligonucleotide
guugcuacuccucuuuucc

SEQ ID NO: 15620 - RNA, 19 nt, Artificial Sequence
  Synthetic oligonucleotide
uugcuacuccucuuuuccu

SEQ ID NO: 15621 - RNA, 19 nt, Artificial Sequence
  Synthetic oligonucleotide
ugcuacuccucuuuuccug

SEQ ID NO: 15622 - RNA, 19 nt, Artificial Sequence
  Synthetic oligonucleotide
gcuacuccucuuuuccuga

SEQ ID NO: 15623 - RNA, 19 nt, Artificial Sequence
  Synthetic oligonucleotide
cuacuccucuuuuccugaa

SEQ ID NO: 15624 - RNA, 19 nt, Artificial Sequence
  Synthetic oligonucleotide
uacuccucuuuuccugaag

SEQ ID NO: 15625 - RNA, 19 nt, Artificial Sequence
  Synthetic oligonucleotide
acuccucuuuuccugaagc

SEQ ID NO: 15626 - RNA, 19 nt, Artificial Sequence
  Synthetic oligonucleotide
cuccucuuuuccugaagcc

SEQ ID NO: 15627 - RNA, 19 nt, Artificial Sequence
  Synthetic oligonucleotide
uccucuuuuccugaagccu

SEQ ID NO: 15628 - RNA, 19 nt, Artificial Sequence
  Synthetic oligonucleotide
ccucuuuuccugaagccug

SEQ ID NO: 15629 - RNA, 19 nt, Artificial Sequence
  Synthetic oligonucleotide
cucuuuuccugaagccugg

SEQ ID NO: 15630 - RNA, 19 nt, Artificial Sequence
  Synthetic oligonucleotide
ucuuuuccugaagccuggg

SEQ ID NO: 15631 - RNA, 19 nt, Artificial Sequence
  Synthetic oligonucleotide
cuuuuccugaagccuggga

SEQ ID NO: 15632 - RNA, 19 nt, Artificial Sequence
  Synthetic oligonucleotide
uuuuccugaagccugggau

SEQ ID NO: 15633 - RNA, 19 nt, Artificial Sequence
  Synthetic oligonucleotide
uuuccugaagccugggauu

SEQ ID NO: 15634 - RNA, 19 nt, Artificial Sequence
  Synthetic oligonucleotide
uuccugaagccugggauuc

SEQ ID NO: 15635 - RNA, 19 nt, Artificial Sequence
  Synthetic oligonucleotide
uccugaagccugggauucc

SEQ ID NO: 15636 - RNA, 19 nt, Artificial Sequence
  Synthetic oligonucleotide
ccugaagccugggauucca

SEQ ID NO: 15637 - RNA, 19 nt, Artificial Sequence
  Synthetic oligonucleotide
cugaagccugggauuccau

SEQ ID NO: 15638 - RNA, 19 nt, Artificial Sequence
  Synthetic oligonucleotide
ugaagccugggauuccaua

SEQ ID NO: 15639 - RNA, 19 nt, Artificial Sequence
  Synthetic oligonucleotide
gaagccugggauuccauau

SEQ ID NO: 15640 - RNA, 19 nt, Artificial Sequence
  Synthetic oligonucleotide
ccaucaaggugcagguuaa

SEQ ID NO: 15641 - RNA, 19 nt, Artificial Sequence
  Synthetic oligonucleotide
caucaaggugcagguuaaa

SEQ ID NO: 15642 - RNA, 19 nt, Artificial Sequence
  Synthetic oligonucleotide
aucaaggugcagguuaaag

SEQ ID NO: 15643 - RNA, 19 nt, Artificial Sequence
  Synthetic oligonucleotide
ucaaggugcagguuaaaga

SEQ ID NO: 15644 - RNA, 19 nt, Artificial Sequence
  Synthetic oligonucleotide
caaggugcagguuaaagau

SEQ ID NO: 15645 - RNA, 19 nt, Artificial Sequence
  Synthetic oligonucleotide
cgcuugaccaguugguagg

SEQ ID NO: 15646 - RNA, 19 nt, Artificial Sequence
  Synthetic oligonucleotide
gcuugaccaguugguagga

SEQ ID NO: 15647 - RNA, 19 nt, Artificial Sequence
  Synthetic oligonucleotide
cuugaccaguugguaggag

SEQ ID NO: 15648 - RNA, 19 nt, Artificial Sequence
  Synthetic oligonucleotide
uugaccaguugguaggagg

SEQ ID NO: 15649 - RNA, 19 nt, Artificial Sequence
  Synthetic oligonucleotide
gucccaguaacacugaaug

SEQ ID NO: 15650 - RNA, 19 nt, Artificial Sequence
  Synthetic oligonucleotide
ucccaguaacacugaaugc

SEQ ID NO: 15651 - RNA, 19 nt, Artificial Sequence
  Synthetic oligonucleotide
cccaguaacacugaaugca

SEQ ID NO: 15652 - RNA, 19 nt, Artificial Sequence
  Synthetic oligonucleotide
ccaguaacacugaaugcac

SEQ ID NO: 15653 - RNA, 19 nt, Artificial Sequence
  Synthetic oligonucleotide
caguaacacugaaugcaca

SEQ ID NO: 15654 - RNA, 19 nt, Artificial Sequence
  Synthetic oligonucleotide
aguaacacugaaugcacaa

SEQ ID NO: 15655 - RNA, 19 nt, Artificial Sequence
  Synthetic oligonucleotide
guaacacugaaugcacaaa

SEQ ID NO: 15656 - RNA, 19 nt, Artificial Sequence
  Synthetic oligonucleotide
uaacacugaaugcacaaac

SEQ ID NO: 15657 - RNA, 19 nt, Artificial Sequence
  Synthetic oligonucleotide
aacacugaaugcacaaaca

SEQ ID NO: 15658 - RNA, 19 nt, Artificial Sequence
  Synthetic oligonucleotide
acacugaaugcacaaacaa

SEQ ID NO: 15659 - RNA, 19 nt, Artificial Sequence
  Synthetic oligonucleotide
cacugaaugcacaaacaau

SEQ ID NO: 15660 - RNA, 19 nt, Artificial Sequence
  Synthetic oligonucleotide
acugaaugcacaaacaauu

SEQ ID NO: 15661 - RNA, 19 nt, Artificial Sequence
  Synthetic oligonucleotide
gaaugcacaaacaauugau

SEQ ID NO: 15662 - RNA, 19 nt, Artificial Sequence
  Synthetic oligonucleotide
aaugcacaaacaauugaug

SEQ ID NO: 15663 - RNA, 19 nt, Artificial Sequence
  Synthetic oligonucleotide
augcacaaacaauugaugu

SEQ ID NO: 15664 - RNA, 19 nt, Artificial Sequence
  Synthetic oligonucleotide
aaccaagagacaucugacu

SEQ ID NO: 15665 - RNA, 19 nt, Artificial Sequence
  Synthetic oligonucleotide
accaagagacaucugacuu

SEQ ID NO: 15666 - RNA, 19 nt, Artificial Sequence
  Synthetic oligonucleotide
ccaagagacaucugacuug

SEQ ID NO: 15667 - RNA, 19 nt, Artificial Sequence
  Synthetic oligonucleotide
aaaaguguaacacguguug

SEQ ID NO: 15668 - RNA, 19 nt, Artificial Sequence
  Synthetic oligonucleotide
aaaguguaacacguguuga

SEQ ID NO: 15669 - RNA, 19 nt, Artificial Sequence
  Synthetic oligonucleotide
aaguguaacacguguugau

SEQ ID NO: 15670 - RNA, 19 nt, Artificial Sequence
  Synthetic oligonucleotide
aguguaacacguguugaug

SEQ ID NO: 15671 - RNA, 19 nt, Artificial Sequence
  Synthetic oligonucleotide
guguaacacguguugauga

SEQ ID NO: 15672 - RNA, 19 nt, Artificial Sequence
  Synthetic oligonucleotide
uguaacacguguugaugau

SEQ ID NO: 15673 - RNA, 19 nt, Artificial Sequence
  Synthetic oligonucleotide
guaacacguguugaugaug

SEQ ID NO: 15674 - RNA, 19 nt, Artificial Sequence
  Synthetic oligonucleotide
uaacacguguugaugaugg

SEQ ID NO: 15675 - RNA, 19 nt, Artificial Sequence
  Synthetic oligonucleotide
aacacguguugaugaugga

SEQ ID NO: 15676 - RNA, 19 nt, Artificial Sequence
  Synthetic oligonucleotide
acacguguugaugauggag

SEQ ID NO: 15677 - RNA, 19 nt, Artificial Sequence
  Synthetic oligonucleotide
cacguguugaugauggagu

SEQ ID NO: 15678 - RNA, 19 nt, Artificial Sequence
  Synthetic oligonucleotide
acguguugaugauggagua

SEQ ID NO: 15679 - RNA, 19 nt, Artificial Sequence
  Synthetic oligonucleotide
cguguugaugauggaguag

SEQ ID NO: 15680 - RNA, 19 nt, Artificial Sequence
  Synthetic oligonucleotide
guguugaugauggaguagc

SEQ ID NO: 15681 - RNA, 19 nt, Artificial Sequence
  Synthetic oligonucleotide
uguugaugauggaguagcu

SEQ ID NO: 15682 - RNA, 19 nt, Artificial Sequence
  Synthetic oligonucleotide
guugaugauggaguagcuu

SEQ ID NO: 15683 - RNA, 19 nt, Artificial Sequence
  Synthetic oligonucleotide
uugaugauggaguagcuuc

SEQ ID NO: 15684 - RNA, 19 nt, Artificial Sequence
  Synthetic oligonucleotide
uuaaucucccaucuggagu

SEQ ID NO: 15685 - RNA, 19 nt, Artificial Sequence
  Synthetic oligonucleotide
uaaucucccaucuggagug

SEQ ID NO: 15686 - RNA, 19 nt, Artificial Sequence
  Synthetic oligonucleotide
aaucucccaucuggaguga

SEQ ID NO: 15687 - RNA, 19 nt, Artificial Sequence
  Synthetic oligonucleotide
aucucccaucuggagugac

SEQ ID NO: 15688 - RNA, 19 nt, Artificial Sequence
  Synthetic oligonucleotide
ucucccaucuggagugacg

SEQ ID NO: 15689 - RNA, 19 nt, Artificial Sequence
  Synthetic oligonucleotide
ucccaucuggagugacggu

SEQ ID NO: 15690 - RNA, 19 nt, Artificial Sequence
  Synthetic oligonucleotide
ccaucuggagugacggugc

SEQ ID NO: 15691 - RNA, 19 nt, Artificial Sequence
  Synthetic oligonucleotide
caucuggagugacggugcu

SEQ ID NO: 15692 - RNA, 19 nt, Artificial Sequence
  Synthetic oligonucleotide
aucuggagugacggugcug

SEQ ID NO: 15693 - RNA, 19 nt, Artificial Sequence
  Synthetic oligonucleotide
ucuggagugacggugcugg

SEQ ID NO: 15694 - RNA, 19 nt, Artificial Sequence
  Synthetic oligonucleotide
cuggagugacggugcugga

SEQ ID NO: 15695 - RNA, 19 nt, Artificial Sequence
  Synthetic oligonucleotide
uggagugacggugcuggag

SEQ ID NO: 15696 - RNA, 19 nt, Artificial Sequence
  Synthetic oligonucleotide
ggagugacggugcuggagu

SEQ ID NO: 15697 - RNA, 19 nt, Artificial Sequence
  Synthetic oligonucleotide
gagugacggugcuggaguu

SEQ ID NO: 15698 - RNA, 19 nt, Artificial Sequence
  Synthetic oligonucleotide
agugacggugcuggaguuu

SEQ ID NO: 15699 - RNA, 19 nt, Artificial Sequence
  Synthetic oligonucleotide
gugacggugcuggaguuua

SEQ ID NO: 15700 - RNA, 19 nt, Artificial Sequence
  Synthetic oligonucleotide
ugacggugcuggaguuuaa

SEQ ID NO: 15701 - RNA, 19 nt, Artificial Sequence
  Synthetic oligonucleotide
gacggugcuggaguuuaau

SEQ ID NO: 15702 - RNA, 19 nt, Artificial Sequence
  Synthetic oligonucleotide
acggugcuggaguuuaaug

SEQ ID NO: 15703 - RNA, 19 nt, Artificial Sequence
  Synthetic oligonucleotide
cggugcuggaguuuaaugu

SEQ ID NO: 15704 - RNA, 19 nt, Artificial Sequence
  Synthetic oligonucleotide
ggugcuggaguuuaauguc

SEQ ID NO: 15705 - RNA, 19 nt, Artificial Sequence
  Synthetic oligonucleotide
gugcuggaguuuaauguca

SEQ ID NO: 15706 - RNA, 19 nt, Artificial Sequence
  Synthetic oligonucleotide
ugcuggaguuuaaugucaa

SEQ ID NO: 15707 - RNA, 19 nt, Artificial Sequence
  Synthetic oligonucleotide
gcuggaguuuaaugucaaa

SEQ ID NO: 15708 - RNA, 19 nt, Artificial Sequence
  Synthetic oligonucleotide
cuggaguuuaaugucaaaa

SEQ ID NO: 15709 - RNA, 19 nt, Artificial Sequence
  Synthetic oligonucleotide
uggaguuuaaugucaaaac

SEQ ID NO: 15710 - RNA, 19 nt, Artificial Sequence
  Synthetic oligonucleotide
ggaguuuaaugucaaaacu

SEQ ID NO: 15711 - RNA, 19 nt, Artificial Sequence
  Synthetic oligonucleotide
gaguuuaaugucaaaacug

SEQ ID NO: 15712 - RNA, 19 nt, Artificial Sequence
  Synthetic oligonucleotide
aguuuaaugucaaaacuga

SEQ ID NO: 15713 - RNA, 19 nt, Artificial Sequence
  Synthetic oligonucleotide
guuuaaugucaaaacugau

SEQ ID NO: 15714 - RNA, 19 nt, Artificial Sequence
  Synthetic oligonucleotide
uuuaaugucaaaacugaug

SEQ ID NO: 15715 - RNA, 19 nt, Artificial Sequence
  Synthetic oligonucleotide
uuaaugucaaaacugaugc

SEQ ID NO: 15716 - RNA, 19 nt, Artificial Sequence
  Synthetic oligonucleotide
uaaugucaaaacugaugcu

SEQ ID NO: 15717 - RNA, 19 nt, Artificial Sequence
  Synthetic oligonucleotide
aaugucaaaacugaugcuc

SEQ ID NO: 15718 - RNA, 19 nt, Artificial Sequence
  Synthetic oligonucleotide
augucaaaacugaugcucc

SEQ ID NO: 15719 - RNA, 19 nt, Artificial Sequence
  Synthetic oligonucleotide
ugucaaaacugaugcucca

SEQ ID NO: 15720 - RNA, 19 nt, Artificial Sequence
  Synthetic oligonucleotide
gucaaaacugaugcuccag

SEQ ID NO: 15721 - RNA, 19 nt, Artificial Sequence
  Synthetic oligonucleotide
ucaaaacugaugcuccaga

SEQ ID NO: 15722 - RNA, 19 nt, Artificial Sequence
  Synthetic oligonucleotide
caaaacugaugcuccagau

SEQ ID NO: 15723 - RNA, 19 nt, Artificial Sequence
  Synthetic oligonucleotide
aaaacugaugcuccagauc

SEQ ID NO: 15724 - RNA, 19 nt, Artificial Sequence
  Synthetic oligonucleotide
aaacugaugcuccagaucu

SEQ ID NO: 15725 - RNA, 19 nt, Artificial Sequence
  Synthetic oligonucleotide
aacugaugcuccagaucuu

SEQ ID NO: 15726 - RNA, 19 nt, Artificial Sequence
  Synthetic oligonucleotide
acugaugcuccagaucuuc

SEQ ID NO: 15727 - RNA, 19 nt, Artificial Sequence
  Synthetic oligonucleotide
cugaugcuccagaucuucc

SEQ ID NO: 15728 - RNA, 19 nt, Artificial Sequence
  Synthetic oligonucleotide
ugaugcuccagaucuucca

SEQ ID NO: 15729 - RNA, 19 nt, Artificial Sequence
  Synthetic oligonucleotide
gaugcuccagaucuuccag

SEQ ID NO: 15730 - RNA, 19 nt, Artificial Sequence
  Synthetic oligonucleotide
augcuccagaucuuccaga

SEQ ID NO: 15731 - RNA, 19 nt, Artificial Sequence
  Synthetic oligonucleotide
gaaaaucaggccagggaag

SEQ ID NO: 15732 - RNA, 19 nt, Artificial Sequence
  Synthetic oligonucleotide
aaaaucaggccagggaagg

SEQ ID NO: 15733 - RNA, 19 nt, Artificial Sequence
  Synthetic oligonucleotide
aaaucaggccagggaaggu

SEQ ID NO: 15734 - RNA, 19 nt, Artificial Sequence
  Synthetic oligonucleotide
aaucaggccagggaagguu

SEQ ID NO: 15735 - RNA, 19 nt, Artificial Sequence
  Synthetic oligonucleotide
aucaggccagggaagguua

SEQ ID NO: 15736 - RNA, 19 nt, Artificial Sequence
  Synthetic oligonucleotide
ucaggccagggaagguuac

SEQ ID NO: 15737 - RNA, 19 nt, Artificial Sequence
  Synthetic oligonucleotide
caggccagggaagguuacc

SEQ ID NO: 15738 - RNA, 19 nt, Artificial Sequence
  Synthetic oligonucleotide
aggccagggaagguuaccg

SEQ ID NO: 15739 - RNA, 19 nt, Artificial Sequence
  Synthetic oligonucleotide
ggccagggaagguuaccga

SEQ ID NO: 15740 - RNA, 19 nt, Artificial Sequence
  Synthetic oligonucleotide
gccagggaagguuaccgag

SEQ ID NO: 15741 - RNA, 19 nt, Artificial Sequence
  Synthetic oligonucleotide
ccagggaagguuaccgagc

SEQ ID NO: 15742 - RNA, 19 nt, Artificial Sequence
  Synthetic oligonucleotide
cagggaagguuaccgagca

SEQ ID NO: 15743 - RNA, 19 nt, Artificial Sequence
  Synthetic oligonucleotide
agggaagguuaccgagcaa

SEQ ID NO: 15744 - RNA, 19 nt, Artificial Sequence
  Synthetic oligonucleotide
gggaagguuaccgagcaau

SEQ ID NO: 15745 - RNA, 19 nt, Artificial Sequence
  Synthetic oligonucleotide
ggaagguuaccgagcaaua

SEQ ID NO: 15746 - RNA, 19 nt, Artificial Sequence
  Synthetic oligonucleotide
gaagguuaccgagcaauag

SEQ ID NO: 15747 - RNA, 19 nt, Artificial Sequence
  Synthetic oligonucleotide
aagguuaccgagcaauagc

SEQ ID NO: 15748 - RNA, 19 nt, Artificial Sequence
  Synthetic oligonucleotide
agguuaccgagcaauagca

SEQ ID NO: 15749 - RNA, 19 nt, Artificial Sequence
  Synthetic oligonucleotide
guuaccgagcaauagcaua

SEQ ID NO: 15750 - RNA, 19 nt, Artificial Sequence
  Synthetic oligonucleotide
uuaccgagcaauagcauac

SEQ ID NO: 15751 - RNA, 19 nt, Artificial Sequence
  Synthetic oligonucleotide
uaccgagcaauagcauacu

SEQ ID NO: 15752 - RNA, 19 nt, Artificial Sequence
  Synthetic oligonucleotide
accgagcaauagcauacuc

SEQ ID NO: 15753 - RNA, 19 nt, Artificial Sequence
  Synthetic oligonucleotide
ccgagcaauagcauacuca

SEQ ID NO: 15754 - RNA, 19 nt, Artificial Sequence
  Synthetic oligonucleotide
cgagcaauagcauacucau

SEQ ID NO: 15755 - RNA, 19 nt, Artificial Sequence
  Synthetic oligonucleotide
gagcaauagcauacucauc

SEQ ID NO: 15756 - RNA, 19 nt, Artificial Sequence
  Synthetic oligonucleotide
agcaauagcauacucaucu

SEQ ID NO: 15757 - RNA, 19 nt, Artificial Sequence
  Synthetic oligonucleotide
gcaauagcauacucaucuc

SEQ ID NO: 15758 - RNA, 19 nt, Artificial Sequence
  Synthetic oligonucleotide
caauagcauacucaucucu

SEQ ID NO: 15759 - RNA, 19 nt, Artificial Sequence
  Synthetic oligonucleotide
aauagcauacucaucucuc

SEQ ID NO: 15760 - RNA, 19 nt, Artificial Sequence
  Synthetic oligonucleotide
auagcauacucaucucuca

SEQ ID NO: 15761 - RNA, 19 nt, Artificial Sequence
  Synthetic oligonucleotide
uagcauacucaucucucag

SEQ ID NO: 15762 - RNA, 19 nt, Artificial Sequence
  Synthetic oligonucleotide
agcauacucaucucucagc

SEQ ID NO: 15763 - RNA, 19 nt, Artificial Sequence
  Synthetic oligonucleotide
gcauacucaucucucagcc

SEQ ID NO: 15764 - RNA, 19 nt, Artificial Sequence
  Synthetic oligonucleotide
cauacucaucucucagcca

SEQ ID NO: 15765 - RNA, 19 nt, Artificial Sequence
  Synthetic oligonucleotide
auacucaucucucagccaa

SEQ ID NO: 15766 - RNA, 19 nt, Artificial Sequence
  Synthetic oligonucleotide
uacucaucucucagccaaa

SEQ ID NO: 15767 - RNA, 19 nt, Artificial Sequence
  Synthetic oligonucleotide
acucaucucucagccaaag

SEQ ID NO: 15768 - RNA, 19 nt, Artificial Sequence
  Synthetic oligonucleotide
cucaucucucagccaaagu

SEQ ID NO: 15769 - RNA, 19 nt, Artificial Sequence
  Synthetic oligonucleotide
ucaucucucagccaaaguu

SEQ ID NO: 15770 - RNA, 19 nt, Artificial Sequence
  Synthetic oligonucleotide
caucucucagccaaaguua

SEQ ID NO: 15771 - RNA, 19 nt, Artificial Sequence
  Synthetic oligonucleotide
aucucucagccaaaguuac

SEQ ID NO: 15772 - RNA, 19 nt, Artificial Sequence
  Synthetic oligonucleotide
ucucucagccaaaguuacc

SEQ ID NO: 15773 - RNA, 19 nt, Artificial Sequence
  Synthetic oligonucleotide
cucucagccaaaguuaccu

SEQ ID NO: 15774 - RNA, 19 nt, Artificial Sequence
  Synthetic oligonucleotide
ucucagccaaaguuaccuu

SEQ ID NO: 15775 - RNA, 19 nt, Artificial Sequence
  Synthetic oligonucleotide
cucagccaaaguuaccuuu

SEQ ID NO: 15776 - RNA, 19 nt, Artificial Sequence
  Synthetic oligonucleotide
aaggcuuugcuagugggag

SEQ ID NO: 15777 - RNA, 19 nt, Artificial Sequence
  Synthetic oligonucleotide
aggcuuugcuagugggaga

SEQ ID NO: 15778 - RNA, 19 nt, Artificial Sequence
  Synthetic oligonucleotide
ggcuuugcuagugggagaa

SEQ ID NO: 15779 - RNA, 19 nt, Artificial Sequence
  Synthetic oligonucleotide
ccaaaagcccauauauuga

SEQ ID NO: 15780 - RNA, 19 nt, Artificial Sequence
  Synthetic oligonucleotide
caaaagcccauauauugac

SEQ ID NO: 15781 - RNA, 19 nt, Artificial Sequence
  Synthetic oligonucleotide
aaagcccauauauugacaa

SEQ ID NO: 15782 - RNA, 19 nt, Artificial Sequence
  Synthetic oligonucleotide
aagcccauauauugacaaa

SEQ ID NO: 15783 - RNA, 19 nt, Artificial Sequence
  Synthetic oligonucleotide
agcccauauauugacaaaa

SEQ ID NO: 15784 - RNA, 19 nt, Artificial Sequence
  Synthetic oligonucleotide
ccauauauugacaaaauaa

SEQ ID NO: 15785 - RNA, 19 nt, Artificial Sequence
  Synthetic oligonucleotide
auauugacaaaauaacuca

SEQ ID NO: 15786 - RNA, 19 nt, Artificial Sequence
  Synthetic oligonucleotide
uauugacaaaauaacucac

SEQ ID NO: 15787 - RNA, 19 nt, Artificial Sequence
  Synthetic oligonucleotide
uugacaaaauaacucacua

SEQ ID NO: 15788 - RNA, 19 nt, Artificial Sequence
  Synthetic oligonucleotide
uacuugauuuuauccaagg

SEQ ID NO: 15789 - RNA, 19 nt, Artificial Sequence
  Synthetic oligonucleotide
acuugauuuuauccaaggg

SEQ ID NO: 15790 - RNA, 19 nt, Artificial Sequence
  Synthetic oligonucleotide
cuugauuuuauccaagggc

SEQ ID NO: 15791 - RNA, 19 nt, Artificial Sequence
  Synthetic oligonucleotide
uugauuuuauccaagggca

SEQ ID NO: 15792 - RNA, 19 nt, Artificial Sequence
  Synthetic oligonucleotide
ugauuuuauccaagggcaa

SEQ ID NO: 15793 - RNA, 19 nt, Artificial Sequence
  Synthetic oligonucleotide
gauuuuauccaagggcaaa

SEQ ID NO: 15794 - RNA, 19 nt, Artificial Sequence
  Synthetic oligonucleotide
auuuuauccaagggcaaaa

SEQ ID NO: 15795 - RNA, 19 nt, Artificial Sequence
  Synthetic oligonucleotide
uuuuauccaagggcaaaau

SEQ ID NO: 15796 - RNA, 19 nt, Artificial Sequence
  Synthetic oligonucleotide
uuuauccaagggcaaaauu

SEQ ID NO: 15797 - RNA, 19 nt, Artificial Sequence
  Synthetic oligonucleotide
uuauccaagggcaaaauua

SEQ ID NO: 15798 - RNA, 19 nt, Artificial Sequence
  Synthetic oligonucleotide
uauccaagggcaaaauuau

SEQ ID NO: 15799 - RNA, 19 nt, Artificial Sequence
  Synthetic oligonucleotide
auccaagggcaaaauuauc

SEQ ID NO: 15800 - RNA, 19 nt, Artificial Sequence
  Synthetic oligonucleotide
uccaagggcaaaauuaucc

SEQ ID NO: 15801 - RNA, 19 nt, Artificial Sequence
  Synthetic oligonucleotide
ccaagggcaaaauuaucca

SEQ ID NO: 15802 - RNA, 19 nt, Artificial Sequence
  Synthetic oligonucleotide
caagggcaaaauuauccac

SEQ ID NO: 15803 - RNA, 19 nt, Artificial Sequence
  Synthetic oligonucleotide
aagggcaaaauuauccacu

SEQ ID NO: 15804 - RNA, 19 nt, Artificial Sequence
  Synthetic oligonucleotide
agggcaaaauuauccacuu

SEQ ID NO: 15805 - RNA, 19 nt, Artificial Sequence
  Synthetic oligonucleotide
gggcaaaauuauccacuuu

SEQ ID NO: 15806 - RNA, 19 nt, Artificial Sequence
  Synthetic oligonucleotide
ggcaaaauuauccacuuug

SEQ ID NO: 15807 - RNA, 19 nt, Artificial Sequence
  Synthetic oligonucleotide
gcaaaauuauccacuuugg

SEQ ID NO: 15808 - RNA, 19 nt, Artificial Sequence
  Synthetic oligonucleotide
caaaauuauccacuuuggc

SEQ ID NO: 15809 - RNA, 19 nt, Artificial Sequence
  Synthetic oligonucleotide
aaaauuauccacuuuggca

SEQ ID NO: 15810 - RNA, 19 nt, Artificial Sequence
  Synthetic oligonucleotide
aaauuauccacuuuggcac

SEQ ID NO: 15811 - RNA, 19 nt, Artificial Sequence
  Synthetic oligonucleotide
uuucagaugcaucuuauca

SEQ ID NO: 15812 - RNA, 19 nt, Artificial Sequence
  Synthetic oligonucleotide
uucagaugcaucuuaucaa

SEQ ID NO: 15813 - RNA, 19 nt, Artificial Sequence
  Synthetic oligonucleotide
ucagaugcaucuuaucaaa

SEQ ID NO: 15814 - RNA, 19 nt, Artificial Sequence
  Synthetic oligonucleotide
cagaugcaucuuaucaaag

SEQ ID NO: 15815 - RNA, 19 nt, Artificial Sequence
  Synthetic oligonucleotide
agaugcaucuuaucaaagu

SEQ ID NO: 15816 - RNA, 19 nt, Artificial Sequence
  Synthetic oligonucleotide
gaugcaucuuaucaaagua

SEQ ID NO: 15817 - RNA, 19 nt, Artificial Sequence
  Synthetic oligonucleotide
augcaucuuaucaaaguau

SEQ ID NO: 15818 - RNA, 19 nt, Artificial Sequence
  Synthetic oligonucleotide
ugcaucuuaucaaaguaua

SEQ ID NO: 15819 - RNA, 19 nt, Artificial Sequence
  Synthetic oligonucleotide
gcaucuuaucaaaguauaa

SEQ ID NO: 15820 - RNA, 19 nt, Artificial Sequence
  Synthetic oligonucleotide
caucuuaucaaaguauaaa

SEQ ID NO: 15821 - RNA, 19 nt, Artificial Sequence
  Synthetic oligonucleotide
aucuuaucaaaguauaaac

SEQ ID NO: 15822 - RNA, 19 nt, Artificial Sequence
  Synthetic oligonucleotide
ucuuaucaaaguauaaaca

SEQ ID NO: 15823 - RNA, 19 nt, Artificial Sequence
  Synthetic oligonucleotide
cuuaucaaaguauaaacau

SEQ ID NO: 15824 - RNA, 19 nt, Artificial Sequence
  Synthetic oligonucleotide
uuaucaaaguauaaacauu

SEQ ID NO: 15825 - RNA, 19 nt, Artificial Sequence
  Synthetic oligonucleotide
uaucaaaguauaaacauuc

SEQ ID NO: 15826 - RNA, 19 nt, Artificial Sequence
  Synthetic oligonucleotide
aucaaaguauaaacauucc

SEQ ID NO: 15827 - RNA, 19 nt, Artificial Sequence
  Synthetic oligonucleotide
ucaaaguauaaacauucca

SEQ ID NO: 15828 - RNA, 19 nt, Artificial Sequence
  Synthetic oligonucleotide
caaaguauaaacauuccag

SEQ ID NO: 15829 - RNA, 19 nt, Artificial Sequence
  Synthetic oligonucleotide
cagaacaugguuccuucau

SEQ ID NO: 15830 - RNA, 19 nt, Artificial Sequence
  Synthetic oligonucleotide
agaacaugguuccuucauc

SEQ ID NO: 15831 - RNA, 19 nt, Artificial Sequence
  Synthetic oligonucleotide
gaacaugguuccuucaucc

SEQ ID NO: 15832 - RNA, 19 nt, Artificial Sequence
  Synthetic oligonucleotide
aacaugguuccuucauccc

SEQ ID NO: 15833 - RNA, 19 nt, Artificial Sequence
  Synthetic oligonucleotide
acaugguuccuucaucccg

SEQ ID NO: 15834 - RNA, 19 nt, Artificial Sequence
  Synthetic oligonucleotide
caugguuccuucaucccga

SEQ ID NO: 15835 - RNA, 19 nt, Artificial Sequence
  Synthetic oligonucleotide
augguuccuucaucccgac

SEQ ID NO: 15836 - RNA, 19 nt, Artificial Sequence
  Synthetic oligonucleotide
ugguuccuucaucccgacu

SEQ ID NO: 15837 - RNA, 19 nt, Artificial Sequence
  Synthetic oligonucleotide
cuggucuauuacaucguca

SEQ ID NO: 15838 - RNA, 19 nt, Artificial Sequence
  Synthetic oligonucleotide
uggucuauuacaucgucac

SEQ ID NO: 15839 - RNA, 19 nt, Artificial Sequence
  Synthetic oligonucleotide
ggucuauuacaucgucaca

SEQ ID NO: 15840 - RNA, 19 nt, Artificial Sequence
  Synthetic oligonucleotide
gucuauuacaucgucacag

SEQ ID NO: 15841 - RNA, 19 nt, Artificial Sequence
  Synthetic oligonucleotide
ucuauuacaucgucacagg

SEQ ID NO: 15842 - RNA, 19 nt, Artificial Sequence
  Synthetic oligonucleotide
cuauuacaucgucacagga

SEQ ID NO: 15843 - RNA, 19 nt, Artificial Sequence
  Synthetic oligonucleotide
uauuacaucgucacaggag

SEQ ID NO: 15844 - RNA, 19 nt, Artificial Sequence
  Synthetic oligonucleotide
auuacaucgucacaggaga

SEQ ID NO: 15845 - RNA, 19 nt, Artificial Sequence
  Synthetic oligonucleotide
cagacagcagaauuagugu

SEQ ID NO: 15846 - RNA, 19 nt, Artificial Sequence
  Synthetic oligonucleotide
agacagcagaauuaguguc

SEQ ID NO: 15847 - RNA, 19 nt, Artificial Sequence
  Synthetic oligonucleotide
gacagcagaauuagugucu

SEQ ID NO: 15848 - RNA, 19 nt, Artificial Sequence
  Synthetic oligonucleotide
acagcagaauuagugucug

SEQ ID NO: 15849 - RNA, 19 nt, Artificial Sequence
  Synthetic oligonucleotide
cagcagaauuagugucuga

SEQ ID NO: 15850 - RNA, 19 nt, Artificial Sequence
  Synthetic oligonucleotide
agcagaauuagugucugau

SEQ ID NO: 15851 - RNA, 19 nt, Artificial Sequence
  Synthetic oligonucleotide
gcagaauuagugucugauu

SEQ ID NO: 15852 - RNA, 19 nt, Artificial Sequence
  Synthetic oligonucleotide
cagaauuagugucugauuc

SEQ ID NO: 15853 - RNA, 19 nt, Artificial Sequence
  Synthetic oligonucleotide
agaauuagugucugauuca

SEQ ID NO: 15854 - RNA, 19 nt, Artificial Sequence
  Synthetic oligonucleotide
gaauuagugucugauucag

SEQ ID NO: 15855 - RNA, 19 nt, Artificial Sequence
  Synthetic oligonucleotide
aauuagugucugauucagu

SEQ ID NO: 15856 - RNA, 19 nt, Artificial Sequence
  Synthetic oligonucleotide
auuagugucugauucaguc

SEQ ID NO: 15857 - RNA, 19 nt, Artificial Sequence
  Synthetic oligonucleotide
uuagugucugauucagucu

SEQ ID NO: 15858 - RNA, 19 nt, Artificial Sequence
  Synthetic oligonucleotide
uagugucugauucagucug

SEQ ID NO: 15859 - RNA, 19 nt, Artificial Sequence
  Synthetic oligonucleotide
agugucugauucagucugg

SEQ ID NO: 15860 - RNA, 19 nt, Artificial Sequence
  Synthetic oligonucleotide
gugucugauucagucuggu

SEQ ID NO: 15861 - RNA, 19 nt, Artificial Sequence
  Synthetic oligonucleotide
ugucugauucagucugguu

SEQ ID NO: 15862 - RNA, 19 nt, Artificial Sequence
  Synthetic oligonucleotide
ucugauucagucugguuaa

SEQ ID NO: 15863 - RNA, 19 nt, Artificial Sequence
  Synthetic oligonucleotide
uucagucugguuaaauauu

SEQ ID NO: 15864 - RNA, 19 nt, Artificial Sequence
  Synthetic oligonucleotide
guuaaauauugaagaaaaa

SEQ ID NO: 15865 - RNA, 19 nt, Artificial Sequence
  Synthetic oligonucleotide
uuaaauauugaagaaaaau

SEQ ID NO: 15866 - RNA, 19 nt, Artificial Sequence
  Synthetic oligonucleotide
uaaauauugaagaaaaaug

SEQ ID NO: 15867 - RNA, 19 nt, Artificial Sequence
  Synthetic oligonucleotide
aaauauugaagaaaaaugu

SEQ ID NO: 15868 - RNA, 19 nt, Artificial Sequence
  Synthetic oligonucleotide
aauauugaagaaaaaugug

SEQ ID NO: 15869 - RNA, 19 nt, Artificial Sequence
  Synthetic oligonucleotide
auauugaagaaaaaugugg

SEQ ID NO: 15870 - RNA, 19 nt, Artificial Sequence
  Synthetic oligonucleotide
uauugaagaaaaauguggc

SEQ ID NO: 15871 - RNA, 19 nt, Artificial Sequence
  Synthetic oligonucleotide
auugaagaaaaauguggca

SEQ ID NO: 15872 - RNA, 19 nt, Artificial Sequence
  Synthetic oligonucleotide
uugaagaaaaauguggcaa

SEQ ID NO: 15873 - RNA, 19 nt, Artificial Sequence
  Synthetic oligonucleotide
ugaagaaaaauguggcaac

SEQ ID NO: 15874 - RNA, 19 nt, Artificial Sequence
  Synthetic oligonucleotide
gaagaaaaauguggcaacc

SEQ ID NO: 15875 - RNA, 19 nt, Artificial Sequence
  Synthetic oligonucleotide
aagaaaaauguggcaacca

SEQ ID NO: 15876 - RNA, 19 nt, Artificial Sequence
  Synthetic oligonucleotide
agaaaaauguggcaaccag

SEQ ID NO: 15877 - RNA, 19 nt, Artificial Sequence
  Synthetic oligonucleotide
gaaaaauguggcaaccagc

SEQ ID NO: 15878 - RNA, 19 nt, Artificial Sequence
  Synthetic oligonucleotide
aaaaauguggcaaccagcu

SEQ ID NO: 15879 - RNA, 19 nt, Artificial Sequence
  Synthetic oligonucleotide
aaaauguggcaaccagcuc

SEQ ID NO: 15880 - RNA, 19 nt, Artificial Sequence
  Synthetic oligonucleotide
aaauguggcaaccagcucc

SEQ ID NO: 15881 - RNA, 19 nt, Artificial Sequence
  Synthetic oligonucleotide
aauguggcaaccagcucca

SEQ ID NO: 15882 - RNA, 19 nt, Artificial Sequence
  Synthetic oligonucleotide
auguggcaaccagcuccag

SEQ ID NO: 15883 - RNA, 19 nt, Artificial Sequence
  Synthetic oligonucleotide
uggcaaccagcuccagguu

SEQ ID NO: 15884 - RNA, 19 nt, Artificial Sequence
  Synthetic oligonucleotide
ggcaaccagcuccagguuc

SEQ ID NO: 15885 - RNA, 19 nt, Artificial Sequence
  Synthetic oligonucleotide
gcaaccagcuccagguuca

SEQ ID NO: 15886 - RNA, 19 nt, Artificial Sequence
  Synthetic oligonucleotide
caaccagcuccagguucau

SEQ ID NO: 15887 - RNA, 19 nt, Artificial Sequence
  Synthetic oligonucleotide
aaccagcuccagguucauc

SEQ ID NO: 15888 - RNA, 19 nt, Artificial Sequence
  Synthetic oligonucleotide
accagcuccagguucaucu

SEQ ID NO: 15889 - RNA, 19 nt, Artificial Sequence
  Synthetic oligonucleotide
ccagcuccagguucaucug

SEQ ID NO: 15890 - RNA, 19 nt, Artificial Sequence
  Synthetic oligonucleotide
cagcuccagguucaucugu

SEQ ID NO: 15891 - RNA, 19 nt, Artificial Sequence
  Synthetic oligonucleotide
agcuccagguucaucuguc

SEQ ID NO: 15892 - RNA, 19 nt, Artificial Sequence
  Synthetic oligonucleotide
gcuccagguucaucugucu

SEQ ID NO: 15893 - RNA, 19 nt, Artificial Sequence
  Synthetic oligonucleotide
cuccagguucaucugucuc

SEQ ID NO: 15894 - RNA, 19 nt, Artificial Sequence
  Synthetic oligonucleotide
uccagguucaucugucucc

SEQ ID NO: 15895 - RNA, 19 nt, Artificial Sequence
  Synthetic oligonucleotide
ccagguucaucugucuccu

SEQ ID NO: 15896 - RNA, 19 nt, Artificial Sequence
  Synthetic oligonucleotide
cagguucaucugucuccug

SEQ ID NO: 15897 - RNA, 19 nt, Artificial Sequence
  Synthetic oligonucleotide
agguucaucugucuccuga

SEQ ID NO: 15898 - RNA, 19 nt, Artificial Sequence
  Synthetic oligonucleotide
gguucaucugucuccugau

SEQ ID NO: 15899 - RNA, 19 nt, Artificial Sequence
  Synthetic oligonucleotide
guucaucugucuccugaug

SEQ ID NO: 15900 - RNA, 19 nt, Artificial Sequence
  Synthetic oligonucleotide
uucaucugucuccugaugc

SEQ ID NO: 15901 - RNA, 19 nt, Artificial Sequence
  Synthetic oligonucleotide
ucaucugucuccugaugca

SEQ ID NO: 15902 - RNA, 19 nt, Artificial Sequence
  Synthetic oligonucleotide
caucugucuccugaugcag

SEQ ID NO: 15903 - RNA, 19 nt, Artificial Sequence
  Synthetic oligonucleotide
aucugucuccugaugcaga

SEQ ID NO: 15904 - RNA, 19 nt, Artificial Sequence
  Synthetic oligonucleotide
ucugucuccugaugcagau

SEQ ID NO: 15905 - RNA, 19 nt, Artificial Sequence
  Synthetic oligonucleotide
auggauuccuggguggcau

SEQ ID NO: 15906 - RNA, 19 nt, Artificial Sequence
  Synthetic oligonucleotide
uggauuccuggguggcauu

SEQ ID NO: 15907 - RNA, 19 nt, Artificial Sequence
  Synthetic oligonucleotide
ggauuccuggguggcauua

SEQ ID NO: 15908 - RNA, 19 nt, Artificial Sequence
  Synthetic oligonucleotide
gagccaaaaagcccuugga

SEQ ID NO: 15909 - RNA, 19 nt, Artificial Sequence
  Synthetic oligonucleotide
agccaaaaagcccuuggaa

SEQ ID NO: 15910 - RNA, 19 nt, Artificial Sequence
  Synthetic oligonucleotide
gccaaaaagcccuuggaaa

SEQ ID NO: 15911 - RNA, 19 nt, Artificial Sequence
  Synthetic oligonucleotide
ccaaaaagcccuuggaaag

SEQ ID NO: 15912 - RNA, 19 nt, Artificial Sequence
  Synthetic oligonucleotide
caaaaagcccuuggaaaga

SEQ ID NO: 15913 - RNA, 19 nt, Artificial Sequence
  Synthetic oligonucleotide
aaaaagcccuuggaaagag

SEQ ID NO: 15914 - RNA, 19 nt, Artificial Sequence
  Synthetic oligonucleotide
aaaagcccuuggaaagagu

SEQ ID NO: 15915 - RNA, 19 nt, Artificial Sequence
  Synthetic oligonucleotide
aaagcccuuggaaagagua

SEQ ID NO: 15916 - RNA, 19 nt, Artificial Sequence
  Synthetic oligonucleotide
aagcccuuggaaagaguau

SEQ ID NO: 15917 - RNA, 19 nt, Artificial Sequence
  Synthetic oligonucleotide
agcccuuggaaagaguauu

SEQ ID NO: 15918 - RNA, 19 nt, Artificial Sequence
  Synthetic oligonucleotide
gcccuuggaaagaguauuu

SEQ ID NO: 15919 - RNA, 19 nt, Artificial Sequence
  Synthetic oligonucleotide
cccuuggaaagaguauuuc

SEQ ID NO: 15920 - RNA, 19 nt, Artificial Sequence
  Synthetic oligonucleotide
ccuuggaaagaguauuuca

SEQ ID NO: 15921 - RNA, 19 nt, Artificial Sequence
  Synthetic oligonucleotide
cuuggaaagaguauuucaa

SEQ ID NO: 15922 - RNA, 19 nt, Artificial Sequence
  Synthetic oligonucleotide
uuggaaagaguauuucaau

SEQ ID NO: 15923 - RNA, 19 nt, Artificial Sequence
  Synthetic oligonucleotide
uggaaagaguauuucaauu

SEQ ID NO: 15924 - RNA, 19 nt, Artificial Sequence
  Synthetic oligonucleotide
ggaaagaguauuucaauuc

SEQ ID NO: 15925 - RNA, 19 nt, Artificial Sequence
  Synthetic oligonucleotide
gaaagaguauuucaauucu

SEQ ID NO: 15926 - RNA, 19 nt, Artificial Sequence
  Synthetic oligonucleotide
aaagaguauuucaauucuu

SEQ ID NO: 15927 - RNA, 19 nt, Artificial Sequence
  Synthetic oligonucleotide
aagaguauuucaauucuua

SEQ ID NO: 15928 - RNA, 19 nt, Artificial Sequence
  Synthetic oligonucleotide
agaguauuucaauucuuag

SEQ ID NO: 15929 - RNA, 19 nt, Artificial Sequence
  Synthetic oligonucleotide
gaguauuucaauucuuaga

SEQ ID NO: 15930 - RNA, 19 nt, Artificial Sequence
  Synthetic oligonucleotide
aguauuucaauucuuagag

SEQ ID NO: 15931 - RNA, 19 nt, Artificial Sequence
  Synthetic oligonucleotide
guauuucaauucuuagaga

SEQ ID NO: 15932 - RNA, 19 nt, Artificial Sequence
  Synthetic oligonucleotide
uauuucaauucuuagagaa

SEQ ID NO: 15933 - RNA, 19 nt, Artificial Sequence
  Synthetic oligonucleotide
auuucaauucuuagagaag

SEQ ID NO: 15934 - RNA, 19 nt, Artificial Sequence
  Synthetic oligonucleotide
uuucaauucuuagagaaga

SEQ ID NO: 15935 - RNA, 19 nt, Artificial Sequence
  Synthetic oligonucleotide
uucaauucuuagagaagag

SEQ ID NO: 15936 - RNA, 19 nt, Artificial Sequence
  Synthetic oligonucleotide
ucaauucuuagagaagagu

SEQ ID NO: 15937 - RNA, 19 nt, Artificial Sequence
  Synthetic oligonucleotide
caauucuuagagaagagug

SEQ ID NO: 15938 - RNA, 19 nt, Artificial Sequence
  Synthetic oligonucleotide
aauucuuagagaagaguga

SEQ ID NO: 15939 - RNA, 19 nt, Artificial Sequence
  Synthetic oligonucleotide
auucuuagagaagagugau

SEQ ID NO: 15940 - RNA, 19 nt, Artificial Sequence
  Synthetic oligonucleotide
uucuuagagaagagugauc

SEQ ID NO: 15941 - RNA, 19 nt, Artificial Sequence
  Synthetic oligonucleotide
cuuagagaagagugaucug

SEQ ID NO: 15942 - RNA, 19 nt, Artificial Sequence
  Synthetic oligonucleotide
uuagagaagagugaucugg

SEQ ID NO: 15943 - RNA, 19 nt, Artificial Sequence
  Synthetic oligonucleotide
agagaagagugaucugggc

SEQ ID NO: 15944 - RNA, 19 nt, Artificial Sequence
  Synthetic oligonucleotide
uggggcaggugguggccuc

SEQ ID NO: 15945 - RNA, 19 nt, Artificial Sequence
  Synthetic oligonucleotide
gcaggugguggccucaaca

SEQ ID NO: 15946 - RNA, 19 nt, Artificial Sequence
  Synthetic oligonucleotide
caggugguggccucaacaa

SEQ ID NO: 15947 - RNA, 19 nt, Artificial Sequence
  Synthetic oligonucleotide
aggugguggccucaacaau

SEQ ID NO: 15948 - RNA, 19 nt, Artificial Sequence
  Synthetic oligonucleotide
ggugguggccucaacaaug

SEQ ID NO: 15949 - RNA, 19 nt, Artificial Sequence
  Synthetic oligonucleotide
gugguggccucaacaaugc

SEQ ID NO: 15950 - RNA, 19 nt, Artificial Sequence
  Synthetic oligonucleotide
ugguggccucaacaaugcc

SEQ ID NO: 15951 - RNA, 19 nt, Artificial Sequence
  Synthetic oligonucleotide
guuccaccuagcuggacuu

SEQ ID NO: 15952 - RNA, 19 nt, Artificial Sequence
  Synthetic oligonucleotide
uuccaccuagcuggacuua

SEQ ID NO: 15953 - RNA, 19 nt, Artificial Sequence
  Synthetic oligonucleotide
uccaccuagcuggacuuac

SEQ ID NO: 15954 - RNA, 19 nt, Artificial Sequence
  Synthetic oligonucleotide
ccaccuagcuggacuuacc

SEQ ID NO: 15955 - RNA, 19 nt, Artificial Sequence
  Synthetic oligonucleotide
caccuagcuggacuuaccu

SEQ ID NO: 15956 - RNA, 19 nt, Artificial Sequence
  Synthetic oligonucleotide
accuagcuggacuuaccuu

SEQ ID NO: 15957 - RNA, 19 nt, Artificial Sequence
  Synthetic oligonucleotide
ccuagcuggacuuaccuuc

SEQ ID NO: 15958 - RNA, 19 nt, Artificial Sequence
  Synthetic oligonucleotide
cuagcuggacuuaccuucc

SEQ ID NO: 15959 - RNA, 19 nt, Artificial Sequence
  Synthetic oligonucleotide
uagcuggacuuaccuuccu

SEQ ID NO: 15960 - RNA, 19 nt, Artificial Sequence
  Synthetic oligonucleotide
agcuggacuuaccuuccuc

SEQ ID NO: 15961 - RNA, 19 nt, Artificial Sequence
  Synthetic oligonucleotide
gcuggacuuaccuuccuca

SEQ ID NO: 15962 - RNA, 19 nt, Artificial Sequence
  Synthetic oligonucleotide
cuggacuuaccuuccucac

SEQ ID NO: 15963 - RNA, 19 nt, Artificial Sequence
  Synthetic oligonucleotide
uggacuuaccuuccucacu

SEQ ID NO: 15964 - RNA, 19 nt, Artificial Sequence
  Synthetic oligonucleotide
ggacuuaccuuccucacua

SEQ ID NO: 15965 - RNA, 19 nt, Artificial Sequence
  Synthetic oligonucleotide
gacuuaccuuccucacuaa

SEQ ID NO: 15966 - RNA, 19 nt, Artificial Sequence
  Synthetic oligonucleotide
acuuaccuuccucacuaau

SEQ ID NO: 15967 - RNA, 19 nt, Artificial Sequence
  Synthetic oligonucleotide
cuuaccuuccucacuaaug

SEQ ID NO: 15968 - RNA, 19 nt, Artificial Sequence
  Synthetic oligonucleotide
uuaccuuccucacuaaugc

SEQ ID NO: 15969 - RNA, 19 nt, Artificial Sequence
  Synthetic oligonucleotide
uaccuuccucacuaaugca

SEQ ID NO: 15970 - RNA, 19 nt, Artificial Sequence
  Synthetic oligonucleotide
accuuccucacuaaugcaa

SEQ ID NO: 15971 - RNA, 19 nt, Artificial Sequence
  Synthetic oligonucleotide
ccuuccucacuaaugcaaa

SEQ ID NO: 15972 - RNA, 19 nt, Artificial Sequence
  Synthetic oligonucleotide
cuuccucacuaaugcaaau

SEQ ID NO: 15973 - RNA, 19 nt, Artificial Sequence
  Synthetic oligonucleotide
uuccucacuaaugcaaaug

SEQ ID NO: 15974 - RNA, 19 nt, Artificial Sequence
  Synthetic oligonucleotide
uccucacuaaugcaaaugc

SEQ ID NO: 15975 - RNA, 19 nt, Artificial Sequence
  Synthetic oligonucleotide
ccucacuaaugcaaaugca

SEQ ID NO: 15976 - RNA, 19 nt, Artificial Sequence
  Synthetic oligonucleotide
cucacuaaugcaaaugcag

SEQ ID NO: 15977 - RNA, 19 nt, Artificial Sequence
  Synthetic oligonucleotide
ucacuaaugcaaaugcaga

SEQ ID NO: 15978 - RNA, 19 nt, Artificial Sequence
  Synthetic oligonucleotide
cacuaaugcaaaugcagau

SEQ ID NO: 15979 - RNA, 19 nt, Artificial Sequence
  Synthetic oligonucleotide
acuaaugcaaaugcagaug

SEQ ID NO: 15980 - RNA, 19 nt, Artificial Sequence
  Synthetic oligonucleotide
cuaaugcaaaugcagauga

SEQ ID NO: 15981 - RNA, 19 nt, Artificial Sequence
  Synthetic oligonucleotide
uaaugcaaaugcagaugac

SEQ ID NO: 15982 - RNA, 19 nt, Artificial Sequence
  Synthetic oligonucleotide
aaugcaaaugcagaugacu

SEQ ID NO: 15983 - RNA, 19 nt, Artificial Sequence
  Synthetic oligonucleotide
augcaaaugcagaugacuc

SEQ ID NO: 15984 - RNA, 19 nt, Artificial Sequence
  Synthetic oligonucleotide
ugcaaaugcagaugacucc

SEQ ID NO: 15985 - RNA, 19 nt, Artificial Sequence
  Synthetic oligonucleotide
gcaaaugcagaugacuccc

SEQ ID NO: 15986 - RNA, 19 nt, Artificial Sequence
  Synthetic oligonucleotide
caaaugcagaugacuccca

SEQ ID NO: 15987 - RNA, 19 nt, Artificial Sequence
  Synthetic oligonucleotide
aaaugcagaugacucccaa

SEQ ID NO: 15988 - RNA, 19 nt, Artificial Sequence
  Synthetic oligonucleotide
aaugcagaugacucccaag

SEQ ID NO: 15989 - RNA, 19 nt, Artificial Sequence
  Synthetic oligonucleotide
augcagaugacucccaaga

SEQ ID NO: 15990 - RNA, 19 nt, Artificial Sequence
  Synthetic oligonucleotide
ugcagaugacucccaagaa

SEQ ID NO: 15991 - RNA, 19 nt, Artificial Sequence
  Synthetic oligonucleotide
gcagaugacucccaagaaa

SEQ ID NO: 15992 - RNA, 19 nt, Artificial Sequence
  Synthetic oligonucleotide
cagaugacucccaagaaaa

SEQ ID NO: 15993 - RNA, 19 nt, Artificial Sequence
  Synthetic oligonucleotide
agaugacucccaagaaaau

SEQ ID NO: 15994 - RNA, 19 nt, Artificial Sequence
  Synthetic oligonucleotide
gaugacucccaagaaaaug

SEQ ID NO: 15995 - RNA, 19 nt, Artificial Sequence
  Synthetic oligonucleotide
augacucccaagaaaauga

SEQ ID NO: 15996 - RNA, 19 nt, Artificial Sequence
  Synthetic oligonucleotide
ugacucccaagaaaaugau

SEQ ID NO: 15997 - RNA, 19 nt, Artificial Sequence
  Synthetic oligonucleotide
gacucccaagaaaaugaug

SEQ ID NO: 15998 - RNA, 19 nt, Artificial Sequence
  Synthetic oligonucleotide
acucccaagaaaaugauga

SEQ ID NO: 15999 - RNA, 19 nt, Artificial Sequence
  Synthetic oligonucleotide
cucccaagaaaaugaugaa

SEQ ID NO: 16000 - RNA, 19 nt, Artificial Sequence
  Synthetic oligonucleotide
ucccaagaaaaugaugaac

SEQ ID NO: 16001 - RNA, 19 nt, Artificial Sequence
  Synthetic oligonucleotide
cccaagaaaaugaugaacc

SEQ ID NO: 16002 - RNA, 19 nt, Artificial Sequence
  Synthetic oligonucleotide
ccaagaaaaugaugaaccu

SEQ ID NO: 16003 - RNA, 19 nt, Artificial Sequence
  Synthetic oligonucleotide
caagaaaaugaugaaccuu

SEQ ID NO: 16004 - RNA, 19 nt, Artificial Sequence
  Synthetic oligonucleotide
aagaaaaugaugaaccuug

SEQ ID NO: 16005 - RNA, 19 nt, Artificial Sequence
  Synthetic oligonucleotide
gaaaaugaugaaccuugua

SEQ ID NO: 16006 - RNA, 19 nt, Artificial Sequence
  Synthetic oligonucleotide
aaaaugaugaaccuuguaa

SEQ ID NO: 16007 - RNA, 19 nt, Artificial Sequence
  Synthetic oligonucleotide
aaaugaugaaccuuguaaa

SEQ ID NO: 16008 - RNA, 19 nt, Artificial Sequence
  Synthetic oligonucleotide
aaugaugaaccuuguaaag

SEQ ID NO: 16009 - RNA, 19 nt, Artificial Sequence
  Synthetic oligonucleotide
ugaugaaccuuguaaagaa

SEQ ID NO: 16010 - RNA, 19 nt, Artificial Sequence
  Synthetic oligonucleotide
ugaaccuuguaaagaaauu

SEQ ID NO: 16011 - RNA, 19 nt, Artificial Sequence
  Synthetic oligonucleotide
agaagauagaagaaauagc

SEQ ID NO: 16012 - RNA, 19 nt, Artificial Sequence
  Synthetic oligonucleotide
gaagauagaagaaauagcu

SEQ ID NO: 16013 - RNA, 19 nt, Artificial Sequence
  Synthetic oligonucleotide
aagauagaagaaauagcug

SEQ ID NO: 16014 - RNA, 19 nt, Artificial Sequence
  Synthetic oligonucleotide
agauagaagaaauagcugc

SEQ ID NO: 16015 - RNA, 19 nt, Artificial Sequence
  Synthetic oligonucleotide
gauagaagaaauagcugcu

SEQ ID NO: 16016 - RNA, 19 nt, Artificial Sequence
  Synthetic oligonucleotide
auagaagaaauagcugcua

SEQ ID NO: 16017 - RNA, 19 nt, Artificial Sequence
  Synthetic oligonucleotide
uagaagaaauagcugcuaa

SEQ ID NO: 16018 - RNA, 19 nt, Artificial Sequence
  Synthetic oligonucleotide
agaagaaauagcugcuaaa

SEQ ID NO: 16019 - RNA, 19 nt, Artificial Sequence
  Synthetic oligonucleotide
gaagaaauagcugcuaaau

SEQ ID NO: 16020 - RNA, 19 nt, Artificial Sequence
  Synthetic oligonucleotide
aagaaauagcugcuaaaua

SEQ ID NO: 16021 - RNA, 19 nt, Artificial Sequence
  Synthetic oligonucleotide
agaaauagcugcuaaauau

SEQ ID NO: 16022 - RNA, 19 nt, Artificial Sequence
  Synthetic oligonucleotide
gaaauagcugcuaaauaua

SEQ ID NO: 16023 - RNA, 19 nt, Artificial Sequence
  Synthetic oligonucleotide
aaauagcugcuaaauauaa

SEQ ID NO: 16024 - RNA, 19 nt, Artificial Sequence
  Synthetic oligonucleotide
aauagcugcuaaauauaaa

SEQ ID NO: 16025 - RNA, 19 nt, Artificial Sequence
  Synthetic oligonucleotide
auagcugcuaaauauaaac

SEQ ID NO: 16026 - RNA, 19 nt, Artificial Sequence
  Synthetic oligonucleotide
uagcugcuaaauauaaaca

SEQ ID NO: 16027 - RNA, 19 nt, Artificial Sequence
  Synthetic oligonucleotide
agcugcuaaauauaaacau

SEQ ID NO: 16028 - RNA, 19 nt, Artificial Sequence
  Synthetic oligonucleotide
gcugcuaaauauaaacauu

SEQ ID NO: 16029 - RNA, 19 nt, Artificial Sequence
  Synthetic oligonucleotide
uagugaagaaauguuguua

SEQ ID NO: 16030 - RNA, 19 nt, Artificial Sequence
  Synthetic oligonucleotide
agugaagaaauguuguuac

SEQ ID NO: 16031 - RNA, 19 nt, Artificial Sequence
  Synthetic oligonucleotide
gugaagaaauguuguuacg

SEQ ID NO: 16032 - RNA, 19 nt, Artificial Sequence
  Synthetic oligonucleotide
ugaagaaauguuguuacga

SEQ ID NO: 16033 - RNA, 19 nt, Artificial Sequence
  Synthetic oligonucleotide
gaagaaauguuguuacgau

SEQ ID NO: 16034 - RNA, 19 nt, Artificial Sequence
  Synthetic oligonucleotide
aagaaauguuguuacgaug

SEQ ID NO: 16035 - RNA, 19 nt, Artificial Sequence
  Synthetic oligonucleotide
agaaauguuguuacgaugg

SEQ ID NO: 16036 - RNA, 19 nt, Artificial Sequence
  Synthetic oligonucleotide
gaaauguuguuacgaugga

SEQ ID NO: 16037 - RNA, 19 nt, Artificial Sequence
  Synthetic oligonucleotide
aaauguuguuacgauggag

SEQ ID NO: 16038 - RNA, 19 nt, Artificial Sequence
  Synthetic oligonucleotide
augaugaaaccugugagca

SEQ ID NO: 16039 - RNA, 19 nt, Artificial Sequence
  Synthetic oligonucleotide
ugaugaaaccugugagcag

SEQ ID NO: 16040 - RNA, 19 nt, Artificial Sequence
  Synthetic oligonucleotide
gaugaaaccugugagcagc

SEQ ID NO: 16041 - RNA, 19 nt, Artificial Sequence
  Synthetic oligonucleotide
augaaaccugugagcagcg

SEQ ID NO: 16042 - RNA, 19 nt, Artificial Sequence
  Synthetic oligonucleotide
ugaaaccugugagcagcga

SEQ ID NO: 16043 - RNA, 19 nt, Artificial Sequence
  Synthetic oligonucleotide
gaaaccugugagcagcgag

SEQ ID NO: 16044 - RNA, 19 nt, Artificial Sequence
  Synthetic oligonucleotide
aaaccugugagcagcgagc

SEQ ID NO: 16045 - RNA, 19 nt, Artificial Sequence
  Synthetic oligonucleotide
ccugugagcagcgagcugc

SEQ ID NO: 16046 - RNA, 19 nt, Artificial Sequence
  Synthetic oligonucleotide
cugugagcagcgagcugca

SEQ ID NO: 16047 - RNA, 19 nt, Artificial Sequence
  Synthetic oligonucleotide
ugugagcagcgagcugcac

SEQ ID NO: 16048 - RNA, 19 nt, Artificial Sequence
  Synthetic oligonucleotide
gugagcagcgagcugcacg

SEQ ID NO: 16049 - RNA, 19 nt, Artificial Sequence
  Synthetic oligonucleotide
ugagcagcgagcugcacgg

SEQ ID NO: 16050 - RNA, 19 nt, Artificial Sequence
  Synthetic oligonucleotide
gagcagcgagcugcacgga

SEQ ID NO: 16051 - RNA, 19 nt, Artificial Sequence
  Synthetic oligonucleotide
agcagcgagcugcacggau

SEQ ID NO: 16052 - RNA, 19 nt, Artificial Sequence
  Synthetic oligonucleotide
gcagcgagcugcacggauu

SEQ ID NO: 16053 - RNA, 19 nt, Artificial Sequence
  Synthetic oligonucleotide
cagcgagcugcacggauua

SEQ ID NO: 16054 - RNA, 19 nt, Artificial Sequence
  Synthetic oligonucleotide
agcgagcugcacggauuag

SEQ ID NO: 16055 - RNA, 19 nt, Artificial Sequence
  Synthetic oligonucleotide
gcgagcugcacggauuagu

SEQ ID NO: 16056 - RNA, 19 nt, Artificial Sequence
  Synthetic oligonucleotide
gucgucgcaagccagcucc

SEQ ID NO: 16057 - RNA, 19 nt, Artificial Sequence
  Synthetic oligonucleotide
ucgucgcaagccagcuccg

SEQ ID NO: 16058 - RNA, 19 nt, Artificial Sequence
  Synthetic oligonucleotide
cgucgcaagccagcuccgu

SEQ ID NO: 16059 - RNA, 19 nt, Artificial Sequence
  Synthetic oligonucleotide
gucgcaagccagcuccgug

SEQ ID NO: 16060 - RNA, 19 nt, Artificial Sequence
  Synthetic oligonucleotide
ucgcaagccagcuccgugc

SEQ ID NO: 16061 - RNA, 19 nt, Artificial Sequence
  Synthetic oligonucleotide
cgcaagccagcuccgugcu

SEQ ID NO: 16062 - RNA, 19 nt, Artificial Sequence
  Synthetic oligonucleotide
gcaagccagcuccgugcua

SEQ ID NO: 16063 - RNA, 19 nt, Artificial Sequence
  Synthetic oligonucleotide
caagccagcuccgugcuaa

SEQ ID NO: 16064 - RNA, 19 nt, Artificial Sequence
  Synthetic oligonucleotide
aagccagcuccgugcuaau

SEQ ID NO: 16065 - RNA, 19 nt, Artificial Sequence
  Synthetic oligonucleotide
agccagcuccgugcuaaua

SEQ ID NO: 16066 - RNA, 19 nt, Artificial Sequence
  Synthetic oligonucleotide
caugaagacccuguuacca

SEQ ID NO: 16067 - RNA, 19 nt, Artificial Sequence
  Synthetic oligonucleotide
augaagacccuguuaccag

SEQ ID NO: 16068 - RNA, 19 nt, Artificial Sequence
  Synthetic oligonucleotide
ugaagacccuguuaccagu

SEQ ID NO: 16069 - RNA, 19 nt, Artificial Sequence
  Synthetic oligonucleotide
aagacccuguuaccaguaa

SEQ ID NO: 16070 - RNA, 19 nt, Artificial Sequence
  Synthetic oligonucleotide
agacccuguuaccaguaag

SEQ ID NO: 16071 - RNA, 19 nt, Artificial Sequence
  Synthetic oligonucleotide
gacccuguuaccaguaagc

SEQ ID NO: 16072 - RNA, 19 nt, Artificial Sequence
  Synthetic oligonucleotide
acccuguuaccaguaagca

SEQ ID NO: 16073 - RNA, 19 nt, Artificial Sequence
  Synthetic oligonucleotide
cccuguuaccaguaagcaa

SEQ ID NO: 16074 - RNA, 19 nt, Artificial Sequence
  Synthetic oligonucleotide
ccuguuaccaguaagcaag

SEQ ID NO: 16075 - RNA, 19 nt, Artificial Sequence
  Synthetic oligonucleotide
cuguuaccaguaagcaagc

SEQ ID NO: 16076 - RNA, 19 nt, Artificial Sequence
  Synthetic oligonucleotide
uguuaccaguaagcaagcc

SEQ ID NO: 16077 - RNA, 19 nt, Artificial Sequence
  Synthetic oligonucleotide
guuaccaguaagcaagcca

SEQ ID NO: 16078 - RNA, 19 nt, Artificial Sequence
  Synthetic oligonucleotide
uuaccaguaagcaagccag

SEQ ID NO: 16079 - RNA, 19 nt, Artificial Sequence
  Synthetic oligonucleotide
uaccaguaagcaagccaga

SEQ ID NO: 16080 - RNA, 19 nt, Artificial Sequence
  Synthetic oligonucleotide
accaguaagcaagccagaa

SEQ ID NO: 16081 - RNA, 19 nt, Artificial Sequence
  Synthetic oligonucleotide
ccaguaagcaagccagaaa

SEQ ID NO: 16082 - RNA, 19 nt, Artificial Sequence
  Synthetic oligonucleotide
caguaagcaagccagaaau

SEQ ID NO: 16083 - RNA, 19 nt, Artificial Sequence
  Synthetic oligonucleotide
aguaagcaagccagaaauu

SEQ ID NO: 16084 - RNA, 19 nt, Artificial Sequence
  Synthetic oligonucleotide
guaagcaagccagaaauuc

SEQ ID NO: 16085 - RNA, 19 nt, Artificial Sequence
  Synthetic oligonucleotide
uaagcaagccagaaauucg

SEQ ID NO: 16086 - RNA, 19 nt, Artificial Sequence
  Synthetic oligonucleotide
aagcaagccagaaauucgg

SEQ ID NO: 16087 - RNA, 19 nt, Artificial Sequence
  Synthetic oligonucleotide
agcaagccagaaauucgga

SEQ ID NO: 16088 - RNA, 19 nt, Artificial Sequence
  Synthetic oligonucleotide
gcaagccagaaauucggag

SEQ ID NO: 16089 - RNA, 19 nt, Artificial Sequence
  Synthetic oligonucleotide
aagccagaaauucggaguu

SEQ ID NO: 16090 - RNA, 19 nt, Artificial Sequence
  Synthetic oligonucleotide
agccagaaauucggaguua

SEQ ID NO: 16091 - RNA, 19 nt, Artificial Sequence
  Synthetic oligonucleotide
gccagaaauucggaguuau

SEQ ID NO: 16092 - RNA, 19 nt, Artificial Sequence
  Synthetic oligonucleotide
ccagaaauucggaguuauu

SEQ ID NO: 16093 - RNA, 19 nt, Artificial Sequence
  Synthetic oligonucleotide
cagaaauucggaguuauuu

SEQ ID NO: 16094 - RNA, 19 nt, Artificial Sequence
  Synthetic oligonucleotide
agaaauucggaguuauuuu

SEQ ID NO: 16095 - RNA, 19 nt, Artificial Sequence
  Synthetic oligonucleotide
gaaauucggaguuauuuuc

SEQ ID NO: 16096 - RNA, 19 nt, Artificial Sequence
  Synthetic oligonucleotide
aaauucggaguuauuuucc

SEQ ID NO: 16097 - RNA, 19 nt, Artificial Sequence
  Synthetic oligonucleotide
aauucggaguuauuuucca

SEQ ID NO: 16098 - RNA, 19 nt, Artificial Sequence
  Synthetic oligonucleotide
auucggaguuauuuuccag

SEQ ID NO: 16099 - RNA, 19 nt, Artificial Sequence
  Synthetic oligonucleotide
uucggaguuauuuuccaga

SEQ ID NO: 16100 - RNA, 19 nt, Artificial Sequence
  Synthetic oligonucleotide
ucggaguuauuuuccagaa

SEQ ID NO: 16101 - RNA, 19 nt, Artificial Sequence
  Synthetic oligonucleotide
cggaguuauuuuccagaaa

SEQ ID NO: 16102 - RNA, 19 nt, Artificial Sequence
  Synthetic oligonucleotide
ggaguuauuuuccagaaag

SEQ ID NO: 16103 - RNA, 19 nt, Artificial Sequence
  Synthetic oligonucleotide
gaguuauuuuccagaaagc

SEQ ID NO: 16104 - RNA, 19 nt, Artificial Sequence
  Synthetic oligonucleotide
aguuauuuuccagaaagcu

SEQ ID NO: 16105 - RNA, 19 nt, Artificial Sequence
  Synthetic oligonucleotide
guuauuuuccagaaagcug

SEQ ID NO: 16106 - RNA, 19 nt, Artificial Sequence
  Synthetic oligonucleotide
uuauuuuccagaaagcugg

SEQ ID NO: 16107 - RNA, 19 nt, Artificial Sequence
  Synthetic oligonucleotide
uauuuuccagaaagcuggu

SEQ ID NO: 16108 - RNA, 19 nt, Artificial Sequence
  Synthetic oligonucleotide
auuuuccagaaagcugguu

SEQ ID NO: 16109 - RNA, 19 nt, Artificial Sequence
  Synthetic oligonucleotide
ugggaaguucaucuuguuc

SEQ ID NO: 16110 - RNA, 19 nt, Artificial Sequence
  Synthetic oligonucleotide
gggaaguucaucuuguucc

SEQ ID NO: 16111 - RNA, 19 nt, Artificial Sequence
  Synthetic oligonucleotide
ggaaguucaucuuguuccc

SEQ ID NO: 16112 - RNA, 19 nt, Artificial Sequence
  Synthetic oligonucleotide
gaaguucaucuuguuccca

SEQ ID NO: 16113 - RNA, 19 nt, Artificial Sequence
  Synthetic oligonucleotide
aaguucaucuuguucccag

SEQ ID NO: 16114 - RNA, 19 nt, Artificial Sequence
  Synthetic oligonucleotide
aguucaucuuguucccaga

SEQ ID NO: 16115 - RNA, 19 nt, Artificial Sequence
  Synthetic oligonucleotide
guucaucuuguucccagaa

SEQ ID NO: 16116 - RNA, 19 nt, Artificial Sequence
  Synthetic oligonucleotide
uucaucuuguucccagaag

SEQ ID NO: 16117 - RNA, 19 nt, Artificial Sequence
  Synthetic oligonucleotide
ucaucuuguucccagaaga

SEQ ID NO: 16118 - RNA, 19 nt, Artificial Sequence
  Synthetic oligonucleotide
caucuuguucccagaagaa

SEQ ID NO: 16119 - RNA, 19 nt, Artificial Sequence
  Synthetic oligonucleotide
aucuuguucccagaagaaa

SEQ ID NO: 16120 - RNA, 19 nt, Artificial Sequence
  Synthetic oligonucleotide
ucuuguucccagaagaaaa

SEQ ID NO: 16121 - RNA, 19 nt, Artificial Sequence
  Synthetic oligonucleotide
cuuguucccagaagaaaac

SEQ ID NO: 16122 - RNA, 19 nt, Artificial Sequence
  Synthetic oligonucleotide
uuguucccagaagaaaaca

SEQ ID NO: 16123 - RNA, 19 nt, Artificial Sequence
  Synthetic oligonucleotide
uguucccagaagaaaacag

SEQ ID NO: 16124 - RNA, 19 nt, Artificial Sequence
  Synthetic oligonucleotide
guucccagaagaaaacagu

SEQ ID NO: 16125 - RNA, 19 nt, Artificial Sequence
  Synthetic oligonucleotide
uucccagaagaaaacaguu

SEQ ID NO: 16126 - RNA, 19 nt, Artificial Sequence
  Synthetic oligonucleotide
ucccagaagaaaacaguug

SEQ ID NO: 16127 - RNA, 19 nt, Artificial Sequence
  Synthetic oligonucleotide
cccagaagaaaacaguugc

SEQ ID NO: 16128 - RNA, 19 nt, Artificial Sequence
  Synthetic oligonucleotide
ccagaagaaaacaguugca

SEQ ID NO: 16129 - RNA, 19 nt, Artificial Sequence
  Synthetic oligonucleotide
cagaagaaaacaguugcag

SEQ ID NO: 16130 - RNA, 19 nt, Artificial Sequence
  Synthetic oligonucleotide
agaagaaaacaguugcagu

SEQ ID NO: 16131 - RNA, 19 nt, Artificial Sequence
  Synthetic oligonucleotide
gaagaaaacaguugcaguu

SEQ ID NO: 16132 - RNA, 19 nt, Artificial Sequence
  Synthetic oligonucleotide
aagaaaacaguugcaguuu

SEQ ID NO: 16133 - RNA, 19 nt, Artificial Sequence
  Synthetic oligonucleotide
agaaaacaguugcaguuug

SEQ ID NO: 16134 - RNA, 19 nt, Artificial Sequence
  Synthetic oligonucleotide
gaaaacaguugcaguuugc

SEQ ID NO: 16135 - RNA, 19 nt, Artificial Sequence
  Synthetic oligonucleotide
aaaacaguugcaguuugcc

SEQ ID NO: 16136 - RNA, 19 nt, Artificial Sequence
  Synthetic oligonucleotide
aaacaguugcaguuugccc

SEQ ID NO: 16137 - RNA, 19 nt, Artificial Sequence
  Synthetic oligonucleotide
aacaguugcaguuugcccu

SEQ ID NO: 16138 - RNA, 19 nt, Artificial Sequence
  Synthetic oligonucleotide
acaguugcaguuugcccua

SEQ ID NO: 16139 - RNA, 19 nt, Artificial Sequence
  Synthetic oligonucleotide
caguugcaguuugcccuac

SEQ ID NO: 16140 - RNA, 19 nt, Artificial Sequence
  Synthetic oligonucleotide
aguugcaguuugcccuacc

SEQ ID NO: 16141 - RNA, 19 nt, Artificial Sequence
  Synthetic oligonucleotide
guugcaguuugcccuaccu

SEQ ID NO: 16142 - RNA, 19 nt, Artificial Sequence
  Synthetic oligonucleotide
uugcaguuugcccuaccug

SEQ ID NO: 16143 - RNA, 19 nt, Artificial Sequence
  Synthetic oligonucleotide
ugcaguuugcccuaccuga

SEQ ID NO: 16144 - RNA, 19 nt, Artificial Sequence
  Synthetic oligonucleotide
gcaguuugcccuaccugau

SEQ ID NO: 16145 - RNA, 19 nt, Artificial Sequence
  Synthetic oligonucleotide
caguuugcccuaccugauu

SEQ ID NO: 16146 - RNA, 19 nt, Artificial Sequence
  Synthetic oligonucleotide
aguuugcccuaccugauuc

SEQ ID NO: 16147 - RNA, 19 nt, Artificial Sequence
  Synthetic oligonucleotide
guuugcccuaccugauucu

SEQ ID NO: 16148 - RNA, 19 nt, Artificial Sequence
  Synthetic oligonucleotide
ggcaaagguguucaaagau

SEQ ID NO: 16149 - RNA, 19 nt, Artificial Sequence
  Synthetic oligonucleotide
gcaaagguguucaaagaug

SEQ ID NO: 16150 - RNA, 19 nt, Artificial Sequence
  Synthetic oligonucleotide
caaagguguucaaagaugu

SEQ ID NO: 16151 - RNA, 19 nt, Artificial Sequence
  Synthetic oligonucleotide
aaagguguucaaagauguc

SEQ ID NO: 16152 - RNA, 19 nt, Artificial Sequence
  Synthetic oligonucleotide
aagguguucaaagaugucu

SEQ ID NO: 16153 - RNA, 19 nt, Artificial Sequence
  Synthetic oligonucleotide
agguguucaaagaugucuu

SEQ ID NO: 16154 - RNA, 19 nt, Artificial Sequence
  Synthetic oligonucleotide
gguguucaaagaugucuuc

SEQ ID NO: 16155 - RNA, 19 nt, Artificial Sequence
  Synthetic oligonucleotide
guguucaaagaugucuucc

SEQ ID NO: 16156 - RNA, 19 nt, Artificial Sequence
  Synthetic oligonucleotide
uguucaaagaugucuuccu

SEQ ID NO: 16157 - RNA, 19 nt, Artificial Sequence
  Synthetic oligonucleotide
guucaaagaugucuuccug

SEQ ID NO: 16158 - RNA, 19 nt, Artificial Sequence
  Synthetic oligonucleotide
uucaaagaugucuuccugg

SEQ ID NO: 16159 - RNA, 19 nt, Artificial Sequence
  Synthetic oligonucleotide
ucaaagaugucuuccugga

SEQ ID NO: 16160 - RNA, 19 nt, Artificial Sequence
  Synthetic oligonucleotide
caaagaugucuuccuggaa

SEQ ID NO: 16161 - RNA, 19 nt, Artificial Sequence
  Synthetic oligonucleotide
aaagaugucuuccuggaaa

SEQ ID NO: 16162 - RNA, 19 nt, Artificial Sequence
  Synthetic oligonucleotide
aagaugucuuccuggaaau

SEQ ID NO: 16163 - RNA, 19 nt, Artificial Sequence
  Synthetic oligonucleotide
agaugucuuccuggaaaug

SEQ ID NO: 16164 - RNA, 19 nt, Artificial Sequence
  Synthetic oligonucleotide
augucuuccuggaaaugaa

SEQ ID NO: 16165 - RNA, 19 nt, Artificial Sequence
  Synthetic oligonucleotide
ugucuuccuggaaaugaau

SEQ ID NO: 16166 - RNA, 19 nt, Artificial Sequence
  Synthetic oligonucleotide
gucuuccuggaaaugaaua

SEQ ID NO: 16167 - RNA, 19 nt, Artificial Sequence
  Synthetic oligonucleotide
ucuuccuggaaaugaauau

SEQ ID NO: 16168 - RNA, 19 nt, Artificial Sequence
  Synthetic oligonucleotide
cuuccuggaaaugaauaua

SEQ ID NO: 16169 - RNA, 19 nt, Artificial Sequence
  Synthetic oligonucleotide
uuccuggaaaugaauauac

SEQ ID NO: 16170 - RNA, 19 nt, Artificial Sequence
  Synthetic oligonucleotide
uccuggaaaugaauauacc

SEQ ID NO: 16171 - RNA, 19 nt, Artificial Sequence
  Synthetic oligonucleotide
ccuggaaaugaauauacca

SEQ ID NO: 16172 - RNA, 19 nt, Artificial Sequence
  Synthetic oligonucleotide
uauaccauauucuguugua

SEQ ID NO: 16173 - RNA, 19 nt, Artificial Sequence
  Synthetic oligonucleotide
auaccauauucuguuguac

SEQ ID NO: 16174 - RNA, 19 nt, Artificial Sequence
  Synthetic oligonucleotide
uaccauauucuguuguacg

SEQ ID NO: 16175 - RNA, 19 nt, Artificial Sequence
  Synthetic oligonucleotide
accauauucuguuguacga

SEQ ID NO: 16176 - RNA, 19 nt, Artificial Sequence
  Synthetic oligonucleotide
ccauauucuguuguacgag

SEQ ID NO: 16177 - RNA, 19 nt, Artificial Sequence
  Synthetic oligonucleotide
cauauucuguuguacgagg

SEQ ID NO: 16178 - RNA, 19 nt, Artificial Sequence
  Synthetic oligonucleotide
auauucuguuguacgagga

SEQ ID NO: 16179 - RNA, 19 nt, Artificial Sequence
  Synthetic oligonucleotide
uauucuguuguacgaggag

SEQ ID NO: 16180 - RNA, 19 nt, Artificial Sequence
  Synthetic oligonucleotide
auucuguuguacgaggaga

SEQ ID NO: 16181 - RNA, 19 nt, Artificial Sequence
  Synthetic oligonucleotide
uucuguuguacgaggagaa

SEQ ID NO: 16182 - RNA, 19 nt, Artificial Sequence
  Synthetic oligonucleotide
ucuguuguacgaggagaac

SEQ ID NO: 16183 - RNA, 19 nt, Artificial Sequence
  Synthetic oligonucleotide
cuguuguacgaggagaaca

SEQ ID NO: 16184 - RNA, 19 nt, Artificial Sequence
  Synthetic oligonucleotide
uguuguacgaggagaacag

SEQ ID NO: 16185 - RNA, 19 nt, Artificial Sequence
  Synthetic oligonucleotide
gaacuguuuacaacuauag

SEQ ID NO: 16186 - RNA, 19 nt, Artificial Sequence
  Synthetic oligonucleotide
aacuguuuacaacuauagg

SEQ ID NO: 16187 - RNA, 19 nt, Artificial Sequence
  Synthetic oligonucleotide
acuguuuacaacuauagga

SEQ ID NO: 16188 - RNA, 19 nt, Artificial Sequence
  Synthetic oligonucleotide
cuguuuacaacuauaggac

SEQ ID NO: 16189 - RNA, 19 nt, Artificial Sequence
  Synthetic oligonucleotide
uguuuacaacuauaggacu

SEQ ID NO: 16190 - RNA, 19 nt, Artificial Sequence
  Synthetic oligonucleotide
guuuacaacuauaggacuu

SEQ ID NO: 16191 - RNA, 19 nt, Artificial Sequence
  Synthetic oligonucleotide
uuuacaacuauaggacuuc

SEQ ID NO: 16192 - RNA, 19 nt, Artificial Sequence
  Synthetic oligonucleotide
uuacaacuauaggacuucu

SEQ ID NO: 16193 - RNA, 19 nt, Artificial Sequence
  Synthetic oligonucleotide
uacaacuauaggacuucug

SEQ ID NO: 16194 - RNA, 19 nt, Artificial Sequence
  Synthetic oligonucleotide
acaacuauaggacuucugg

SEQ ID NO: 16195 - RNA, 19 nt, Artificial Sequence
  Synthetic oligonucleotide
caacuauaggacuucuggg

SEQ ID NO: 16196 - RNA, 19 nt, Artificial Sequence
  Synthetic oligonucleotide
aacuauaggacuucuggga

SEQ ID NO: 16197 - RNA, 19 nt, Artificial Sequence
  Synthetic oligonucleotide
acuauaggacuucugggau

SEQ ID NO: 16198 - RNA, 19 nt, Artificial Sequence
  Synthetic oligonucleotide
cuauaggacuucugggaug

SEQ ID NO: 16199 - RNA, 19 nt, Artificial Sequence
  Synthetic oligonucleotide
uauaggacuucugggaugc

SEQ ID NO: 16200 - RNA, 19 nt, Artificial Sequence
  Synthetic oligonucleotide
auaggacuucugggaugca

SEQ ID NO: 16201 - RNA, 19 nt, Artificial Sequence
  Synthetic oligonucleotide
uaggacuucugggaugcag

SEQ ID NO: 16202 - RNA, 19 nt, Artificial Sequence
  Synthetic oligonucleotide
aggacuucugggaugcagu

SEQ ID NO: 16203 - RNA, 19 nt, Artificial Sequence
  Synthetic oligonucleotide
aaugucugcuguggaggga

SEQ ID NO: 16204 - RNA, 19 nt, Artificial Sequence
  Synthetic oligonucleotide
augucugcuguggagggaa

SEQ ID NO: 16205 - RNA, 19 nt, Artificial Sequence
  Synthetic oligonucleotide
ugucugcuguggagggaau

SEQ ID NO: 16206 - RNA, 19 nt, Artificial Sequence
  Synthetic oligonucleotide
gucugcuguggagggaauc

SEQ ID NO: 16207 - RNA, 19 nt, Artificial Sequence
  Synthetic oligonucleotide
ucugcuguggagggaaucu

SEQ ID NO: 16208 - RNA, 19 nt, Artificial Sequence
  Synthetic oligonucleotide
cugcuguggagggaaucug

SEQ ID NO: 16209 - RNA, 19 nt, Artificial Sequence
  Synthetic oligonucleotide
ugcuguggagggaaucugc

SEQ ID NO: 16210 - RNA, 19 nt, Artificial Sequence
  Synthetic oligonucleotide
gcuguggagggaaucugca

SEQ ID NO: 16211 - RNA, 19 nt, Artificial Sequence
  Synthetic oligonucleotide
cuguggagggaaucugcac

SEQ ID NO: 16212 - RNA, 19 nt, Artificial Sequence
  Synthetic oligonucleotide
uguggagggaaucugcacu

SEQ ID NO: 16213 - RNA, 19 nt, Artificial Sequence
  Synthetic oligonucleotide
guggagggaaucugcacuu

SEQ ID NO: 16214 - RNA, 19 nt, Artificial Sequence
  Synthetic oligonucleotide
uggagggaaucugcacuuc

SEQ ID NO: 16215 - RNA, 19 nt, Artificial Sequence
  Synthetic oligonucleotide
gaaagcccagucauugauc

SEQ ID NO: 16216 - RNA, 19 nt, Artificial Sequence
  Synthetic oligonucleotide
aaagcccagucauugauca

SEQ ID NO: 16217 - RNA, 19 nt, Artificial Sequence
  Synthetic oligonucleotide
aagcccagucauugaucau

SEQ ID NO: 16218 - RNA, 19 nt, Artificial Sequence
  Synthetic oligonucleotide
agcccagucauugaucauc

SEQ ID NO: 16219 - RNA, 19 nt, Artificial Sequence
  Synthetic oligonucleotide
gcccagucauugaucauca

SEQ ID NO: 16220 - RNA, 19 nt, Artificial Sequence
  Synthetic oligonucleotide
cccagucauugaucaucag

SEQ ID NO: 16221 - RNA, 19 nt, Artificial Sequence
  Synthetic oligonucleotide
ccagucauugaucaucagg

SEQ ID NO: 16222 - RNA, 19 nt, Artificial Sequence
  Synthetic oligonucleotide
cagucauugaucaucaggg

SEQ ID NO: 16223 - RNA, 19 nt, Artificial Sequence
  Synthetic oligonucleotide
agucauugaucaucagggc

SEQ ID NO: 16224 - RNA, 19 nt, Artificial Sequence
  Synthetic oligonucleotide
gucauugaucaucagggca

SEQ ID NO: 16225 - RNA, 19 nt, Artificial Sequence
  Synthetic oligonucleotide
ucauugaucaucagggcac

SEQ ID NO: 16226 - RNA, 19 nt, Artificial Sequence
  Synthetic oligonucleotide
cauugaucaucagggcaca

SEQ ID NO: 16227 - RNA, 19 nt, Artificial Sequence
  Synthetic oligonucleotide
auugaucaucagggcacaa

SEQ ID NO: 16228 - RNA, 19 nt, Artificial Sequence
  Synthetic oligonucleotide
uugaucaucagggcacaaa

SEQ ID NO: 16229 - RNA, 19 nt, Artificial Sequence
  Synthetic oligonucleotide
ugaucaucagggcacaaag

SEQ ID NO: 16230 - RNA, 19 nt, Artificial Sequence
  Synthetic oligonucleotide
gaucaucagggcacaaagu

SEQ ID NO: 16231 - RNA, 19 nt, Artificial Sequence
  Synthetic oligonucleotide
aucaucagggcacaaaguc

SEQ ID NO: 16232 - RNA, 19 nt, Artificial Sequence
  Synthetic oligonucleotide
ucaucagggcacaaagucc

SEQ ID NO: 16233 - RNA, 19 nt, Artificial Sequence
  Synthetic oligonucleotide
caucagggcacaaaguccu

SEQ ID NO: 16234 - RNA, 19 nt, Artificial Sequence
  Synthetic oligonucleotide
aucagggcacaaaguccuc

SEQ ID NO: 16235 - RNA, 19 nt, Artificial Sequence
  Synthetic oligonucleotide
ucagggcacaaaguccucc

SEQ ID NO: 16236 - RNA, 19 nt, Artificial Sequence
  Synthetic oligonucleotide
cagggcacaaaguccucca

SEQ ID NO: 16237 - RNA, 19 nt, Artificial Sequence
  Synthetic oligonucleotide
agaaaguagagggcuccuc

SEQ ID NO: 16238 - RNA, 19 nt, Artificial Sequence
  Synthetic oligonucleotide
acugugcuuccucuggaaa

SEQ ID NO: 16239 - RNA, 19 nt, Artificial Sequence
  Synthetic oligonucleotide
cugugcuuccucuggaaau

SEQ ID NO: 16240 - RNA, 19 nt, Artificial Sequence
  Synthetic oligonucleotide
ugugcuuccucuggaaauu

SEQ ID NO: 16241 - RNA, 19 nt, Artificial Sequence
  Synthetic oligonucleotide
gugcuuccucuggaaauug

SEQ ID NO: 16242 - RNA, 19 nt, Artificial Sequence
  Synthetic oligonucleotide
guuuggaaaagaaaucuua

SEQ ID NO: 16243 - RNA, 19 nt, Artificial Sequence
  Synthetic oligonucleotide
uuuggaaaagaaaucuuag

SEQ ID NO: 16244 - RNA, 19 nt, Artificial Sequence
  Synthetic oligonucleotide
uuggaaaagaaaucuuagu

SEQ ID NO: 16245 - RNA, 19 nt, Artificial Sequence
  Synthetic oligonucleotide
uggaaaagaaaucuuagua

SEQ ID NO: 16246 - RNA, 19 nt, Artificial Sequence
  Synthetic oligonucleotide
ggaaaagaaaucuuaguaa

SEQ ID NO: 16247 - RNA, 19 nt, Artificial Sequence
  Synthetic oligonucleotide
gaaaagaaaucuuaguaaa

SEQ ID NO: 16248 - RNA, 19 nt, Artificial Sequence
  Synthetic oligonucleotide
aaaagaaaucuuaguaaaa

SEQ ID NO: 16249 - RNA, 19 nt, Artificial Sequence
  Synthetic oligonucleotide
uuacgaguggugccagaag

SEQ ID NO: 16250 - RNA, 19 nt, Artificial Sequence
  Synthetic oligonucleotide
uacgaguggugccagaagg

SEQ ID NO: 16251 - RNA, 19 nt, Artificial Sequence
  Synthetic oligonucleotide
acgaguggugccagaaggu

SEQ ID NO: 16252 - RNA, 19 nt, Artificial Sequence
  Synthetic oligonucleotide
cgaguggugccagaaggug

SEQ ID NO: 16253 - RNA, 19 nt, Artificial Sequence
  Synthetic oligonucleotide
gaguggugccagaaggugu

SEQ ID NO: 16254 - RNA, 19 nt, Artificial Sequence
  Synthetic oligonucleotide
aguggugccagaagguguc

SEQ ID NO: 16255 - RNA, 19 nt, Artificial Sequence
  Synthetic oligonucleotide
guggugccagaagguguca

SEQ ID NO: 16256 - RNA, 19 nt, Artificial Sequence
  Synthetic oligonucleotide
uggugccagaaggugucaa

SEQ ID NO: 16257 - RNA, 19 nt, Artificial Sequence
  Synthetic oligonucleotide
ggugccagaaggugucaaa

SEQ ID NO: 16258 - RNA, 19 nt, Artificial Sequence
  Synthetic oligonucleotide
gugccagaaggugucaaaa

SEQ ID NO: 16259 - RNA, 19 nt, Artificial Sequence
  Synthetic oligonucleotide
ugccagaaggugucaaaag

SEQ ID NO: 16260 - RNA, 19 nt, Artificial Sequence
  Synthetic oligonucleotide
gccagaaggugucaaaagg

SEQ ID NO: 16261 - RNA, 19 nt, Artificial Sequence
  Synthetic oligonucleotide
ccagaaggugucaaaaggg

SEQ ID NO: 16262 - RNA, 19 nt, Artificial Sequence
  Synthetic oligonucleotide
cagaaggugucaaaaggga

SEQ ID NO: 16263 - RNA, 19 nt, Artificial Sequence
  Synthetic oligonucleotide
agaaggugucaaaagggaa

SEQ ID NO: 16264 - RNA, 19 nt, Artificial Sequence
  Synthetic oligonucleotide
gaaggugucaaaagggaaa

SEQ ID NO: 16265 - RNA, 19 nt, Artificial Sequence
  Synthetic oligonucleotide
aaggugucaaaagggaaag

SEQ ID NO: 16266 - RNA, 19 nt, Artificial Sequence
  Synthetic oligonucleotide
aggugucaaaagggaaagc

SEQ ID NO: 16267 - RNA, 19 nt, Artificial Sequence
  Synthetic oligonucleotide
ggugucaaaagggaaagcu

SEQ ID NO: 16268 - RNA, 19 nt, Artificial Sequence
  Synthetic oligonucleotide
gugucaaaagggaaagcua

SEQ ID NO: 16269 - RNA, 19 nt, Artificial Sequence
  Synthetic oligonucleotide
ugucaaaagggaaagcuau

SEQ ID NO: 16270 - RNA, 19 nt, Artificial Sequence
  Synthetic oligonucleotide
gucaaaagggaaagcuauu

SEQ ID NO: 16271 - RNA, 19 nt, Artificial Sequence
  Synthetic oligonucleotide
ucaaaagggaaagcuauuc

SEQ ID NO: 16272 - RNA, 19 nt, Artificial Sequence
  Synthetic oligonucleotide
caaaagggaaagcuauucu

SEQ ID NO: 16273 - RNA, 19 nt, Artificial Sequence
  Synthetic oligonucleotide
aaaagggaaagcuauucug

SEQ ID NO: 16274 - RNA, 19 nt, Artificial Sequence
  Synthetic oligonucleotide
aaagggaaagcuauucugg

SEQ ID NO: 16275 - RNA, 19 nt, Artificial Sequence
  Synthetic oligonucleotide
aagggaaagcuauucuggu

SEQ ID NO: 16276 - RNA, 19 nt, Artificial Sequence
  Synthetic oligonucleotide
uuacuuuggauccuagggg

SEQ ID NO: 16277 - RNA, 19 nt, Artificial Sequence
  Synthetic oligonucleotide
uacuuuggauccuaggggu

SEQ ID NO: 16278 - RNA, 19 nt, Artificial Sequence
  Synthetic oligonucleotide
acuuuggauccuaggggua

SEQ ID NO: 16279 - RNA, 19 nt, Artificial Sequence
  Synthetic oligonucleotide
cuuuggauccuagggguau

SEQ ID NO: 16280 - RNA, 19 nt, Artificial Sequence
  Synthetic oligonucleotide
uuuggauccuagggguauu

SEQ ID NO: 16281 - RNA, 19 nt, Artificial Sequence
  Synthetic oligonucleotide
uuggauccuagggguauuu

SEQ ID NO: 16282 - RNA, 19 nt, Artificial Sequence
  Synthetic oligonucleotide
uggauccuagggguauuua

SEQ ID NO: 16283 - RNA, 19 nt, Artificial Sequence
  Synthetic oligonucleotide
ggauccuagggguauuuau

SEQ ID NO: 16284 - RNA, 19 nt, Artificial Sequence
  Synthetic oligonucleotide
gauccuagggguauuuaug

SEQ ID NO: 16285 - RNA, 19 nt, Artificial Sequence
  Synthetic oligonucleotide
cgaaaggaguucccauaca

SEQ ID NO: 16286 - RNA, 19 nt, Artificial Sequence
  Synthetic oligonucleotide
gaaaggaguucccauacag

SEQ ID NO: 16287 - RNA, 19 nt, Artificial Sequence
  Synthetic oligonucleotide
aaaggaguucccauacagg

SEQ ID NO: 16288 - RNA, 19 nt, Artificial Sequence
  Synthetic oligonucleotide
aaggaguucccauacagga

SEQ ID NO: 16289 - RNA, 19 nt, Artificial Sequence
  Synthetic oligonucleotide
aggaguucccauacaggau

SEQ ID NO: 16290 - RNA, 19 nt, Artificial Sequence
  Synthetic oligonucleotide
ggaguucccauacaggaua

SEQ ID NO: 16291 - RNA, 19 nt, Artificial Sequence
  Synthetic oligonucleotide
gaguucccauacaggauac

SEQ ID NO: 16292 - RNA, 19 nt, Artificial Sequence
  Synthetic oligonucleotide
aguucccauacaggauacc

SEQ ID NO: 16293 - RNA, 19 nt, Artificial Sequence
  Synthetic oligonucleotide
uuagauuugguccccaaaa

SEQ ID NO: 16294 - RNA, 19 nt, Artificial Sequence
  Synthetic oligonucleotide
uagauuugguccccaaaac

SEQ ID NO: 16295 - RNA, 19 nt, Artificial Sequence
  Synthetic oligonucleotide
agauuugguccccaaaaca

SEQ ID NO: 16296 - RNA, 19 nt, Artificial Sequence
  Synthetic oligonucleotide
gauuugguccccaaaacag

SEQ ID NO: 16297 - RNA, 19 nt, Artificial Sequence
  Synthetic oligonucleotide
auuugguccccaaaacaga

SEQ ID NO: 16298 - RNA, 19 nt, Artificial Sequence
  Synthetic oligonucleotide
uuugguccccaaaacagaa

SEQ ID NO: 16299 - RNA, 19 nt, Artificial Sequence
  Synthetic oligonucleotide
uugguccccaaaacagaaa

SEQ ID NO: 16300 - RNA, 19 nt, Artificial Sequence
  Synthetic oligonucleotide
ugguccccaaaacagaaau

SEQ ID NO: 16301 - RNA, 19 nt, Artificial Sequence
  Synthetic oligonucleotide
gguccccaaaacagaaauc

SEQ ID NO: 16302 - RNA, 19 nt, Artificial Sequence
  Synthetic oligonucleotide
guccccaaaacagaaauca

SEQ ID NO: 16303 - RNA, 19 nt, Artificial Sequence
  Synthetic oligonucleotide
uccccaaaacagaaaucaa

SEQ ID NO: 16304 - RNA, 19 nt, Artificial Sequence
  Synthetic oligonucleotide
ccccaaaacagaaaucaaa

SEQ ID NO: 16305 - RNA, 19 nt, Artificial Sequence
  Synthetic oligonucleotide
cccaaaacagaaaucaaaa

SEQ ID NO: 16306 - RNA, 19 nt, Artificial Sequence
  Synthetic oligonucleotide
ccaaaacagaaaucaaaag

SEQ ID NO: 16307 - RNA, 19 nt, Artificial Sequence
  Synthetic oligonucleotide
caaaacagaaaucaaaagg

SEQ ID NO: 16308 - RNA, 19 nt, Artificial Sequence
  Synthetic oligonucleotide
aaaacagaaaucaaaagga

SEQ ID NO: 16309 - RNA, 19 nt, Artificial Sequence
  Synthetic oligonucleotide
aaacagaaaucaaaaggau

SEQ ID NO: 16310 - RNA, 19 nt, Artificial Sequence
  Synthetic oligonucleotide
aacagaaaucaaaaggauu

SEQ ID NO: 16311 - RNA, 19 nt, Artificial Sequence
  Synthetic oligonucleotide
acagaaaucaaaaggauuu

SEQ ID NO: 16312 - RNA, 19 nt, Artificial Sequence
  Synthetic oligonucleotide
cagaaaucaaaaggauuuu

SEQ ID NO: 16313 - RNA, 19 nt, Artificial Sequence
  Synthetic oligonucleotide
aaaucaaaaggauuuugag

SEQ ID NO: 16314 - RNA, 19 nt, Artificial Sequence
  Synthetic oligonucleotide
aaucaaaaggauuuugagu

SEQ ID NO: 16315 - RNA, 19 nt, Artificial Sequence
  Synthetic oligonucleotide
aucaaaaggauuuugagug

SEQ ID NO: 16316 - RNA, 19 nt, Artificial Sequence
  Synthetic oligonucleotide
ucaaaaggauuuugagugu

SEQ ID NO: 16317 - RNA, 19 nt, Artificial Sequence
  Synthetic oligonucleotide
aaaaggauuuugaguguaa

SEQ ID NO: 16318 - RNA, 19 nt, Artificial Sequence
  Synthetic oligonucleotide
aaaggauuuugaguguaaa

SEQ ID NO: 16319 - RNA, 19 nt, Artificial Sequence
  Synthetic oligonucleotide
aaggauuuugaguguaaaa

SEQ ID NO: 16320 - RNA, 19 nt, Artificial Sequence
  Synthetic oligonucleotide
aggauuuugaguguaaaag

SEQ ID NO: 16321 - RNA, 19 nt, Artificial Sequence
  Synthetic oligonucleotide
ggauuuugaguguaaaagg

SEQ ID NO: 16322 - RNA, 19 nt, Artificial Sequence
  Synthetic oligonucleotide
gauuuugaguguaaaagga

SEQ ID NO: 16323 - RNA, 19 nt, Artificial Sequence
  Synthetic oligonucleotide
auuuugaguguaaaaggac

SEQ ID NO: 16324 - RNA, 19 nt, Artificial Sequence
  Synthetic oligonucleotide
uuuugaguguaaaaggacu

SEQ ID NO: 16325 - RNA, 19 nt, Artificial Sequence
  Synthetic oligonucleotide
uuugaguguaaaaggacug

SEQ ID NO: 16326 - RNA, 19 nt, Artificial Sequence
  Synthetic oligonucleotide
uugaguguaaaaggacugc

SEQ ID NO: 16327 - RNA, 19 nt, Artificial Sequence
  Synthetic oligonucleotide
ugaguguaaaaggacugcu

SEQ ID NO: 16328 - RNA, 19 nt, Artificial Sequence
  Synthetic oligonucleotide
gaguguaaaaggacugcuu

SEQ ID NO: 16329 - RNA, 19 nt, Artificial Sequence
  Synthetic oligonucleotide
aguguaaaaggacugcuug

SEQ ID NO: 16330 - RNA, 19 nt, Artificial Sequence
  Synthetic oligonucleotide
guguaaaaggacugcuugu

SEQ ID NO: 16331 - RNA, 19 nt, Artificial Sequence
  Synthetic oligonucleotide
uguaaaaggacugcuugua

SEQ ID NO: 16332 - RNA, 19 nt, Artificial Sequence
  Synthetic oligonucleotide
guaaaaggacugcuuguag

SEQ ID NO: 16333 - RNA, 19 nt, Artificial Sequence
  Synthetic oligonucleotide
uaaaaggacugcuuguagg

SEQ ID NO: 16334 - RNA, 19 nt, Artificial Sequence
  Synthetic oligonucleotide
aaaaggacugcuuguaggu

SEQ ID NO: 16335 - RNA, 19 nt, Artificial Sequence
  Synthetic oligonucleotide
aaaggacugcuuguaggug

SEQ ID NO: 16336 - RNA, 19 nt, Artificial Sequence
  Synthetic oligonucleotide
aaggacugcuuguagguga

SEQ ID NO: 16337 - RNA, 19 nt, Artificial Sequence
  Synthetic oligonucleotide
aggacugcuuguaggugag

SEQ ID NO: 16338 - RNA, 19 nt, Artificial Sequence
  Synthetic oligonucleotide
ggacugcuuguaggugaga

SEQ ID NO: 16339 - RNA, 19 nt, Artificial Sequence
  Synthetic oligonucleotide
gacugcuuguaggugagau

SEQ ID NO: 16340 - RNA, 19 nt, Artificial Sequence
  Synthetic oligonucleotide
acugcuuguaggugagauc

SEQ ID NO: 16341 - RNA, 19 nt, Artificial Sequence
  Synthetic oligonucleotide
cugcuuguaggugagaucu

SEQ ID NO: 16342 - RNA, 19 nt, Artificial Sequence
  Synthetic oligonucleotide
ugcuuguaggugagaucuu

SEQ ID NO: 16343 - RNA, 19 nt, Artificial Sequence
  Synthetic oligonucleotide
gcuuguaggugagaucuug

SEQ ID NO: 16344 - RNA, 19 nt, Artificial Sequence
  Synthetic oligonucleotide
cuuguaggugagaucuugu

SEQ ID NO: 16345 - RNA, 19 nt, Artificial Sequence
  Synthetic oligonucleotide
uuguaggugagaucuuguc

SEQ ID NO: 16346 - RNA, 19 nt, Artificial Sequence
  Synthetic oligonucleotide
uguaggugagaucuugucu

SEQ ID NO: 16347 - RNA, 19 nt, Artificial Sequence
  Synthetic oligonucleotide
guaggugagaucuugucug

SEQ ID NO: 16348 - RNA, 19 nt, Artificial Sequence
  Synthetic oligonucleotide
uaggugagaucuugucugc

SEQ ID NO: 16349 - RNA, 19 nt, Artificial Sequence
  Synthetic oligonucleotide
aggugagaucuugucugca

SEQ ID NO: 16350 - RNA, 19 nt, Artificial Sequence
  Synthetic oligonucleotide
ggugagaucuugucugcag

SEQ ID NO: 16351 - RNA, 19 nt, Artificial Sequence
  Synthetic oligonucleotide
gugagaucuugucugcagu

SEQ ID NO: 16352 - RNA, 19 nt, Artificial Sequence
  Synthetic oligonucleotide
ugagaucuugucugcaguu

SEQ ID NO: 16353 - RNA, 19 nt, Artificial Sequence
  Synthetic oligonucleotide
gagaucuugucugcaguuc

SEQ ID NO: 16354 - RNA, 19 nt, Artificial Sequence
  Synthetic oligonucleotide
agaucuugucugcaguucu

SEQ ID NO: 16355 - RNA, 19 nt, Artificial Sequence
  Synthetic oligonucleotide
gaucuugucugcaguucua

SEQ ID NO: 16356 - RNA, 19 nt, Artificial Sequence
  Synthetic oligonucleotide
aucuugucugcaguucuaa

SEQ ID NO: 16357 - RNA, 19 nt, Artificial Sequence
  Synthetic oligonucleotide
ucuugucugcaguucuaag

SEQ ID NO: 16358 - RNA, 19 nt, Artificial Sequence
  Synthetic oligonucleotide
cuugucugcaguucuaagu

SEQ ID NO: 16359 - RNA, 19 nt, Artificial Sequence
  Synthetic oligonucleotide
uugucugcaguucuaaguc

SEQ ID NO: 16360 - RNA, 19 nt, Artificial Sequence
  Synthetic oligonucleotide
ggaaggcaucaauauccua

SEQ ID NO: 16361 - RNA, 19 nt, Artificial Sequence
  Synthetic oligonucleotide
gaaggcaucaauauccuaa

SEQ ID NO: 16362 - RNA, 19 nt, Artificial Sequence
  Synthetic oligonucleotide
aaggcaucaauauccuaac

SEQ ID NO: 16363 - RNA, 19 nt, Artificial Sequence
  Synthetic oligonucleotide
aggcaucaauauccuaacc

SEQ ID NO: 16364 - RNA, 19 nt, Artificial Sequence
  Synthetic oligonucleotide
ggcaucaauauccuaaccc

SEQ ID NO: 16365 - RNA, 19 nt, Artificial Sequence
  Synthetic oligonucleotide
gcaucaauauccuaaccca

SEQ ID NO: 16366 - RNA, 19 nt, Artificial Sequence
  Synthetic oligonucleotide
caucaauauccuaacccac

SEQ ID NO: 16367 - RNA, 19 nt, Artificial Sequence
  Synthetic oligonucleotide
aucaauauccuaacccacc

SEQ ID NO: 16368 - RNA, 19 nt, Artificial Sequence
  Synthetic oligonucleotide
ucaauauccuaacccaccu

SEQ ID NO: 16369 - RNA, 19 nt, Artificial Sequence
  Synthetic oligonucleotide
caauauccuaacccaccuc

SEQ ID NO: 16370 - RNA, 19 nt, Artificial Sequence
  Synthetic oligonucleotide
aauauccuaacccaccucc

SEQ ID NO: 16371 - RNA, 19 nt, Artificial Sequence
  Synthetic oligonucleotide
auauccuaacccaccuccc

SEQ ID NO: 16372 - RNA, 19 nt, Artificial Sequence
  Synthetic oligonucleotide
uauccuaacccaccucccc

SEQ ID NO: 16373 - RNA, 19 nt, Artificial Sequence
  Synthetic oligonucleotide
aacccaccuccccaaaggg

SEQ ID NO: 16374 - RNA, 19 nt, Artificial Sequence
  Synthetic oligonucleotide
acccaccuccccaaaggga

SEQ ID NO: 16375 - RNA, 19 nt, Artificial Sequence
  Synthetic oligonucleotide
cccaccuccccaaagggag

SEQ ID NO: 16376 - RNA, 19 nt, Artificial Sequence
  Synthetic oligonucleotide
gaggcggagcugaugagcg

SEQ ID NO: 16377 - RNA, 19 nt, Artificial Sequence
  Synthetic oligonucleotide
gcggagcugaugagcguug

SEQ ID NO: 16378 - RNA, 19 nt, Artificial Sequence
  Synthetic oligonucleotide
cggagcugaugagcguugu

SEQ ID NO: 16379 - RNA, 19 nt, Artificial Sequence
  Synthetic oligonucleotide
ggagcugaugagcguuguc

SEQ ID NO: 16380 - RNA, 19 nt, Artificial Sequence
  Synthetic oligonucleotide
gagcugaugagcguugucc

SEQ ID NO: 16381 - RNA, 19 nt, Artificial Sequence
  Synthetic oligonucleotide
agcugaugagcguuguccc

SEQ ID NO: 16382 - RNA, 19 nt, Artificial Sequence
  Synthetic oligonucleotide
gcugaugagcguuguccca

SEQ ID NO: 16383 - RNA, 19 nt, Artificial Sequence
  Synthetic oligonucleotide
cugaugagcguugucccag

SEQ ID NO: 16384 - RNA, 19 nt, Artificial Sequence
  Synthetic oligonucleotide
ugaugagcguugucccagu

SEQ ID NO: 16385 - RNA, 19 nt, Artificial Sequence
  Synthetic oligonucleotide
gaugagcguugucccagua

SEQ ID NO: 16386 - RNA, 19 nt, Artificial Sequence
  Synthetic oligonucleotide
augagcguugucccaguau

SEQ ID NO: 16387 - RNA, 19 nt, Artificial Sequence
  Synthetic oligonucleotide
ugagcguugucccaguauu

SEQ ID NO: 16388 - RNA, 19 nt, Artificial Sequence
  Synthetic oligonucleotide
gagcguugucccaguauuc

SEQ ID NO: 16389 - RNA, 19 nt, Artificial Sequence
  Synthetic oligonucleotide
agcguugucccaguauucu

SEQ ID NO: 16390 - RNA, 19 nt, Artificial Sequence
  Synthetic oligonucleotide
gcguugucccaguauucua

SEQ ID NO: 16391 - RNA, 19 nt, Artificial Sequence
  Synthetic oligonucleotide
cguugucccaguauucuau

SEQ ID NO: 16392 - RNA, 19 nt, Artificial Sequence
  Synthetic oligonucleotide
guugucccaguauucuaug

SEQ ID NO: 16393 - RNA, 19 nt, Artificial Sequence
  Synthetic oligonucleotide
uugucccaguauucuaugu

SEQ ID NO: 16394 - RNA, 19 nt, Artificial Sequence
  Synthetic oligonucleotide
ugucccaguauucuauguu

SEQ ID NO: 16395 - RNA, 19 nt, Artificial Sequence
  Synthetic oligonucleotide
gucccaguauucuauguuu

SEQ ID NO: 16396 - RNA, 19 nt, Artificial Sequence
  Synthetic oligonucleotide
ucccaguauucuauguuuu

SEQ ID NO: 16397 - RNA, 19 nt, Artificial Sequence
  Synthetic oligonucleotide
cccaguauucuauguuuuu

SEQ ID NO: 16398 - RNA, 19 nt, Artificial Sequence
  Synthetic oligonucleotide
caguauucuauguuuuuca

SEQ ID NO: 16399 - RNA, 19 nt, Artificial Sequence
  Synthetic oligonucleotide
aguauucuauguuuuucac

SEQ ID NO: 16400 - RNA, 19 nt, Artificial Sequence
  Synthetic oligonucleotide
guauucuauguuuuucacu

SEQ ID NO: 16401 - RNA, 19 nt, Artificial Sequence
  Synthetic oligonucleotide
uauucuauguuuuucacua

SEQ ID NO: 16402 - RNA, 19 nt, Artificial Sequence
  Synthetic oligonucleotide
auucuauguuuuucacuac

SEQ ID NO: 16403 - RNA, 19 nt, Artificial Sequence
  Synthetic oligonucleotide
uucuauguuuuucacuacc

SEQ ID NO: 16404 - RNA, 19 nt, Artificial Sequence
  Synthetic oligonucleotide
ucuauguuuuucacuaccu

SEQ ID NO: 16405 - RNA, 19 nt, Artificial Sequence
  Synthetic oligonucleotide
cuauguuuuucacuaccug

SEQ ID NO: 16406 - RNA, 19 nt, Artificial Sequence
  Synthetic oligonucleotide
uauguuuuucacuaccugg

SEQ ID NO: 16407 - RNA, 19 nt, Artificial Sequence
  Synthetic oligonucleotide
auguuuuucacuaccugga

SEQ ID NO: 16408 - RNA, 19 nt, Artificial Sequence
  Synthetic oligonucleotide
uguuuuucacuaccuggaa

SEQ ID NO: 16409 - RNA, 19 nt, Artificial Sequence
  Synthetic oligonucleotide
guuuuucacuaccuggaaa

SEQ ID NO: 16410 - RNA, 19 nt, Artificial Sequence
  Synthetic oligonucleotide
uuuuucacuaccuggaaac

SEQ ID NO: 16411 - RNA, 19 nt, Artificial Sequence
  Synthetic oligonucleotide
uuuucacuaccuggaaaca

SEQ ID NO: 16412 - RNA, 19 nt, Artificial Sequence
  Synthetic oligonucleotide
uuucacuaccuggaaacag

SEQ ID NO: 16413 - RNA, 19 nt, Artificial Sequence
  Synthetic oligonucleotide
uucacuaccuggaaacagg

SEQ ID NO: 16414 - RNA, 19 nt, Artificial Sequence
  Synthetic oligonucleotide
ucacuaccuggaaacagga

SEQ ID NO: 16415 - RNA, 19 nt, Artificial Sequence
  Synthetic oligonucleotide
cacuaccuggaaacaggaa

SEQ ID NO: 16416 - RNA, 19 nt, Artificial Sequence
  Synthetic oligonucleotide
acuaccuggaaacaggaaa

SEQ ID NO: 16417 - RNA, 19 nt, Artificial Sequence
  Synthetic oligonucleotide
cuaccuggaaacaggaaau

SEQ ID NO: 16418 - RNA, 19 nt, Artificial Sequence
  Synthetic oligonucleotide
uaccuggaaacaggaaauc

SEQ ID NO: 16419 - RNA, 19 nt, Artificial Sequence
  Synthetic oligonucleotide
accuggaaacaggaaauca

SEQ ID NO: 16420 - RNA, 19 nt, Artificial Sequence
  Synthetic oligonucleotide
ccuggaaacaggaaaucau

SEQ ID NO: 16421 - RNA, 19 nt, Artificial Sequence
  Synthetic oligonucleotide
cuggaaacaggaaaucauu

SEQ ID NO: 16422 - RNA, 19 nt, Artificial Sequence
  Synthetic oligonucleotide
uggaaacaggaaaucauug

SEQ ID NO: 16423 - RNA, 19 nt, Artificial Sequence
  Synthetic oligonucleotide
ggaaacaggaaaucauugg

SEQ ID NO: 16424 - RNA, 19 nt, Artificial Sequence
  Synthetic oligonucleotide
gaaacaggaaaucauugga

SEQ ID NO: 16425 - RNA, 19 nt, Artificial Sequence
  Synthetic oligonucleotide
aaacaggaaaucauuggaa

SEQ ID NO: 16426 - RNA, 19 nt, Artificial Sequence
  Synthetic oligonucleotide
aacaggaaaucauuggaac

SEQ ID NO: 16427 - RNA, 19 nt, Artificial Sequence
  Synthetic oligonucleotide
acaggaaaucauuggaaca

SEQ ID NO: 16428 - RNA, 19 nt, Artificial Sequence
  Synthetic oligonucleotide
caggaaaucauuggaacau

SEQ ID NO: 16429 - RNA, 19 nt, Artificial Sequence
  Synthetic oligonucleotide
gaaaucauuggaacauuuu

SEQ ID NO: 16430 - RNA, 19 nt, Artificial Sequence
  Synthetic oligonucleotide
aaaucauuggaacauuuuu

SEQ ID NO: 16431 - RNA, 19 nt, Artificial Sequence
  Synthetic oligonucleotide
aaucauuggaacauuuuuc

SEQ ID NO: 16432 - RNA, 19 nt, Artificial Sequence
  Synthetic oligonucleotide
aucauuggaacauuuuuca

SEQ ID NO: 16433 - RNA, 19 nt, Artificial Sequence
  Synthetic oligonucleotide
ucauuggaacauuuuucau

SEQ ID NO: 16434 - RNA, 19 nt, Artificial Sequence
  Synthetic oligonucleotide
cauuggaacauuuuucauu

SEQ ID NO: 16435 - RNA, 19 nt, Artificial Sequence
  Synthetic oligonucleotide
auuggaacauuuuucauuc

SEQ ID NO: 16436 - RNA, 19 nt, Artificial Sequence
  Synthetic oligonucleotide
gacccauuaauugaaaagc

SEQ ID NO: 16437 - RNA, 19 nt, Artificial Sequence
  Synthetic oligonucleotide
agaaaaaauuaaaagaagg

SEQ ID NO: 16438 - RNA, 19 nt, Artificial Sequence
  Synthetic oligonucleotide
gaaaaaauuaaaagaaggg

SEQ ID NO: 16439 - RNA, 19 nt, Artificial Sequence
  Synthetic oligonucleotide
aaaaaauuaaaagaaggga

SEQ ID NO: 16440 - RNA, 19 nt, Artificial Sequence
  Synthetic oligonucleotide
aaaaauuaaaagaagggau

SEQ ID NO: 16441 - RNA, 19 nt, Artificial Sequence
  Synthetic oligonucleotide
aaaauuaaaagaagggaug

SEQ ID NO: 16442 - RNA, 19 nt, Artificial Sequence
  Synthetic oligonucleotide
ugagcauuauguccuacag

SEQ ID NO: 16443 - RNA, 19 nt, Artificial Sequence
  Synthetic oligonucleotide
agcauuauguccuacagaa

SEQ ID NO: 16444 - RNA, 19 nt, Artificial Sequence
  Synthetic oligonucleotide
gcauuauguccuacagaaa

SEQ ID NO: 16445 - RNA, 19 nt, Artificial Sequence
  Synthetic oligonucleotide
cauuauguccuacagaaau

SEQ ID NO: 16446 - RNA, 19 nt, Artificial Sequence
  Synthetic oligonucleotide
auuauguccuacagaaaug

SEQ ID NO: 16447 - RNA, 19 nt, Artificial Sequence
  Synthetic oligonucleotide
uuauguccuacagaaaugc

SEQ ID NO: 16448 - RNA, 19 nt, Artificial Sequence
  Synthetic oligonucleotide
uauguccuacagaaaugcu

SEQ ID NO: 16449 - RNA, 19 nt, Artificial Sequence
  Synthetic oligonucleotide
auguccuacagaaaugcug

SEQ ID NO: 16450 - RNA, 19 nt, Artificial Sequence
  Synthetic oligonucleotide
uguccuacagaaaugcuga

SEQ ID NO: 16451 - RNA, 19 nt, Artificial Sequence
  Synthetic oligonucleotide
guccuacagaaaugcugac

SEQ ID NO: 16452 - RNA, 19 nt, Artificial Sequence
  Synthetic oligonucleotide
uccuacagaaaugcugacu

SEQ ID NO: 16453 - RNA, 19 nt, Artificial Sequence
  Synthetic oligonucleotide
ccuacagaaaugcugacua

SEQ ID NO: 16454 - RNA, 19 nt, Artificial Sequence
  Synthetic oligonucleotide
agugcuagcacuugguuaa

SEQ ID NO: 16455 - RNA, 19 nt, Artificial Sequence
  Synthetic oligonucleotide
gugcuagcacuugguuaac

SEQ ID NO: 16456 - RNA, 19 nt, Artificial Sequence
  Synthetic oligonucleotide
ugcuagcacuugguuaaca

SEQ ID NO: 16457 - RNA, 19 nt, Artificial Sequence
  Synthetic oligonucleotide
gcuagcacuugguuaacag

SEQ ID NO: 16458 - RNA, 19 nt, Artificial Sequence
  Synthetic oligonucleotide
cuagcacuugguuaacagc

SEQ ID NO: 16459 - RNA, 19 nt, Artificial Sequence
  Synthetic oligonucleotide
uagcacuugguuaacagcu

SEQ ID NO: 16460 - RNA, 19 nt, Artificial Sequence
  Synthetic oligonucleotide
agcacuugguuaacagcuu

SEQ ID NO: 16461 - RNA, 19 nt, Artificial Sequence
  Synthetic oligonucleotide
gcacuugguuaacagcuuu

SEQ ID NO: 16462 - RNA, 19 nt, Artificial Sequence
  Synthetic oligonucleotide
cacuugguuaacagcuuuu

SEQ ID NO: 16463 - RNA, 19 nt, Artificial Sequence
  Synthetic oligonucleotide
acuugguuaacagcuuuug

SEQ ID NO: 16464 - RNA, 19 nt, Artificial Sequence
  Synthetic oligonucleotide
uugguuaacagcuuuugcu

SEQ ID NO: 16465 - RNA, 19 nt, Artificial Sequence
  Synthetic oligonucleotide
ugguuaacagcuuuugcuu

SEQ ID NO: 16466 - RNA, 19 nt, Artificial Sequence
  Synthetic oligonucleotide
uuaacagcuuuugcuuuaa

SEQ ID NO: 16467 - RNA, 19 nt, Artificial Sequence
  Synthetic oligonucleotide
uaacagcuuuugcuuuaag

SEQ ID NO: 16468 - RNA, 19 nt, Artificial Sequence
  Synthetic oligonucleotide
aacagcuuuugcuuuaaga

SEQ ID NO: 16469 - RNA, 19 nt, Artificial Sequence
  Synthetic oligonucleotide
acagcuuuugcuuuaagag

SEQ ID NO: 16470 - RNA, 19 nt, Artificial Sequence
  Synthetic oligonucleotide
cagcuuuugcuuuaagagu

SEQ ID NO: 16471 - RNA, 19 nt, Artificial Sequence
  Synthetic oligonucleotide
agcuuuugcuuuaagagua

SEQ ID NO: 16472 - RNA, 19 nt, Artificial Sequence
  Synthetic oligonucleotide
gcuuuugcuuuaagaguac

SEQ ID NO: 16473 - RNA, 19 nt, Artificial Sequence
  Synthetic oligonucleotide
cuuuugcuuuaagaguacu

SEQ ID NO: 16474 - RNA, 19 nt, Artificial Sequence
  Synthetic oligonucleotide
uuuugcuuuaagaguacuu

SEQ ID NO: 16475 - RNA, 19 nt, Artificial Sequence
  Synthetic oligonucleotide
uuugcuuuaagaguacuug

SEQ ID NO: 16476 - RNA, 19 nt, Artificial Sequence
  Synthetic oligonucleotide
uugcuuuaagaguacuugg

SEQ ID NO: 16477 - RNA, 19 nt, Artificial Sequence
  Synthetic oligonucleotide
ugcuuuaagaguacuugga

SEQ ID NO: 16478 - RNA, 19 nt, Artificial Sequence
  Synthetic oligonucleotide
uuuaagaguacuuggacaa

SEQ ID NO: 16479 - RNA, 19 nt, Artificial Sequence
  Synthetic oligonucleotide
uuaagaguacuuggacaag

SEQ ID NO: 16480 - RNA, 19 nt, Artificial Sequence
  Synthetic oligonucleotide
guagagcagaaccaaaauu

SEQ ID NO: 16481 - RNA, 19 nt, Artificial Sequence
  Synthetic oligonucleotide
uguaauucuuuauuguggc

SEQ ID NO: 16482 - RNA, 19 nt, Artificial Sequence
  Synthetic oligonucleotide
guaauucuuuauuguggcu

SEQ ID NO: 16483 - RNA, 19 nt, Artificial Sequence
  Synthetic oligonucleotide
uucaaggaaaauucacagu

SEQ ID NO: 16484 - RNA, 19 nt, Artificial Sequence
  Synthetic oligonucleotide
ucaaggaaaauucacagua

SEQ ID NO: 16485 - RNA, 19 nt, Artificial Sequence
  Synthetic oligonucleotide
caaggaaaauucacaguau

SEQ ID NO: 16486 - RNA, 19 nt, Artificial Sequence
  Synthetic oligonucleotide
aaggaaaauucacaguauc

SEQ ID NO: 16487 - RNA, 19 nt, Artificial Sequence
  Synthetic oligonucleotide
aggaaaauucacaguauca

SEQ ID NO: 16488 - RNA, 19 nt, Artificial Sequence
  Synthetic oligonucleotide
ggaaaauucacaguaucaa

SEQ ID NO: 16489 - RNA, 19 nt, Artificial Sequence
  Synthetic oligonucleotide
gaaaauucacaguaucaac

SEQ ID NO: 16490 - RNA, 19 nt, Artificial Sequence
  Synthetic oligonucleotide
aaaauucacaguaucaacc

SEQ ID NO: 16491 - RNA, 19 nt, Artificial Sequence
  Synthetic oligonucleotide
aaauucacaguaucaacca

SEQ ID NO: 16492 - RNA, 19 nt, Artificial Sequence
  Synthetic oligonucleotide
aauucacaguaucaaccaa

SEQ ID NO: 16493 - RNA, 19 nt, Artificial Sequence
  Synthetic oligonucleotide
auucacaguaucaaccaau

SEQ ID NO: 16494 - RNA, 19 nt, Artificial Sequence
  Synthetic oligonucleotide
uucacaguaucaaccaaua

SEQ ID NO: 16495 - RNA, 19 nt, Artificial Sequence
  Synthetic oligonucleotide
ucacaguaucaaccaauaa

SEQ ID NO: 16496 - RNA, 19 nt, Artificial Sequence
  Synthetic oligonucleotide
acaguaucaaccaauaaaa

SEQ ID NO: 16497 - RNA, 19 nt, Artificial Sequence
  Synthetic oligonucleotide
caguaucaaccaauaaaau

SEQ ID NO: 16498 - RNA, 19 nt, Artificial Sequence
  Synthetic oligonucleotide
aguaucaaccaauaaaauu

SEQ ID NO: 16499 - RNA, 19 nt, Artificial Sequence
  Synthetic oligonucleotide
guaucaaccaauaaaauua

SEQ ID NO: 16500 - RNA, 19 nt, Artificial Sequence
  Synthetic oligonucleotide
uaucaaccaauaaaauuac

SEQ ID NO: 16501 - RNA, 19 nt, Artificial Sequence
  Synthetic oligonucleotide
aucaaccaauaaaauuaca

SEQ ID NO: 16502 - RNA, 19 nt, Artificial Sequence
  Synthetic oligonucleotide
ucaaccaauaaaauuacag

SEQ ID NO: 16503 - RNA, 19 nt, Artificial Sequence
  Synthetic oligonucleotide
cagcucuaauuaaagcuga

SEQ ID NO: 16504 - RNA, 19 nt, Artificial Sequence
  Synthetic oligonucleotide
agcucuaauuaaagcugac

SEQ ID NO: 16505 - RNA, 19 nt, Artificial Sequence
  Synthetic oligonucleotide
gcucuaauuaaagcugaca

SEQ ID NO: 16506 - RNA, 19 nt, Artificial Sequence
  Synthetic oligonucleotide
cuuucugcuugaaaauaca

SEQ ID NO: 16507 - RNA, 19 nt, Artificial Sequence
  Synthetic oligonucleotide
uuucugcuugaaaauacac

SEQ ID NO: 16508 - RNA, 19 nt, Artificial Sequence
  Synthetic oligonucleotide
uucugcuugaaaauacacu

SEQ ID NO: 16509 - RNA, 19 nt, Artificial Sequence
  Synthetic oligonucleotide
ucugcuugaaaauacacug

SEQ ID NO: 16510 - RNA, 19 nt, Artificial Sequence
  Synthetic oligonucleotide
cugcuugaaaauacacugc

SEQ ID NO: 16511 - RNA, 19 nt, Artificial Sequence
  Synthetic oligonucleotide
ugcuugaaaauacacugcc

SEQ ID NO: 16512 - RNA, 19 nt, Artificial Sequence
  Synthetic oligonucleotide
gcuugaaaauacacugcca

SEQ ID NO: 16513 - RNA, 19 nt, Artificial Sequence
  Synthetic oligonucleotide
cuugaaaauacacugccag

SEQ ID NO: 16514 - RNA, 19 nt, Artificial Sequence
  Synthetic oligonucleotide
uugaaaauacacugccagc

SEQ ID NO: 16515 - RNA, 19 nt, Artificial Sequence
  Synthetic oligonucleotide
ugaaaauacacugccagcc

SEQ ID NO: 16516 - RNA, 19 nt, Artificial Sequence
  Synthetic oligonucleotide
gaaaauacacugccagccc

SEQ ID NO: 16517 - RNA, 19 nt, Artificial Sequence
  Synthetic oligonucleotide
aaaauacacugccagccca

SEQ ID NO: 16518 - RNA, 19 nt, Artificial Sequence
  Synthetic oligonucleotide
aaauacacugccagcccag

SEQ ID NO: 16519 - RNA, 19 nt, Artificial Sequence
  Synthetic oligonucleotide
aauacacugccagcccaga

SEQ ID NO: 16520 - RNA, 19 nt, Artificial Sequence
  Synthetic oligonucleotide
auacacugccagcccagag

SEQ ID NO: 16521 - RNA, 19 nt, Artificial Sequence
  Synthetic oligonucleotide
uacacugccagcccagagc

SEQ ID NO: 16522 - RNA, 19 nt, Artificial Sequence
  Synthetic oligonucleotide
acacugccagcccagagca

SEQ ID NO: 16523 - RNA, 19 nt, Artificial Sequence
  Synthetic oligonucleotide
cacugccagcccagagcac

SEQ ID NO: 16524 - RNA, 19 nt, Artificial Sequence
  Synthetic oligonucleotide
acugccagcccagagcacc

SEQ ID NO: 16525 - RNA, 19 nt, Artificial Sequence
  Synthetic oligonucleotide
cugccagcccagagcaccu

SEQ ID NO: 16526 - RNA, 19 nt, Artificial Sequence
  Synthetic oligonucleotide
ugccagcccagagcaccuu

SEQ ID NO: 16527 - RNA, 19 nt, Artificial Sequence
  Synthetic oligonucleotide
gccagcccagagcaccuuu

SEQ ID NO: 16528 - RNA, 19 nt, Artificial Sequence
  Synthetic oligonucleotide
ccagcccagagcaccuuua

SEQ ID NO: 16529 - RNA, 19 nt, Artificial Sequence
  Synthetic oligonucleotide
cagcccagagcaccuuuac

SEQ ID NO: 16530 - RNA, 19 nt, Artificial Sequence
  Synthetic oligonucleotide
agcccagagcaccuuuaca

SEQ ID NO: 16531 - RNA, 19 nt, Artificial Sequence
  Synthetic oligonucleotide
gcccagagcaccuuuacau

SEQ ID NO: 16532 - RNA, 19 nt, Artificial Sequence
  Synthetic oligonucleotide
cccagagcaccuuuacauu

SEQ ID NO: 16533 - RNA, 19 nt, Artificial Sequence
  Synthetic oligonucleotide
ccagagcaccuuuacauug

SEQ ID NO: 16534 - RNA, 19 nt, Artificial Sequence
  Synthetic oligonucleotide
cagagcaccuuuacauugg

SEQ ID NO: 16535 - RNA, 19 nt, Artificial Sequence
  Synthetic oligonucleotide
agagcaccuuuacauuggc

SEQ ID NO: 16536 - RNA, 19 nt, Artificial Sequence
  Synthetic oligonucleotide
gagcaccuuuacauuggcc

SEQ ID NO: 16537 - RNA, 19 nt, Artificial Sequence
  Synthetic oligonucleotide
agcaccuuuacauuggcca

SEQ ID NO: 16538 - RNA, 19 nt, Artificial Sequence
  Synthetic oligonucleotide
gcaccuuuacauuggccau

SEQ ID NO: 16539 - RNA, 19 nt, Artificial Sequence
  Synthetic oligonucleotide
caccuuuacauuggccauu

SEQ ID NO: 16540 - RNA, 19 nt, Artificial Sequence
  Synthetic oligonucleotide
accuuuacauuggccauuu

SEQ ID NO: 16541 - RNA, 19 nt, Artificial Sequence
  Synthetic oligonucleotide
ccuuuacauuggccauuuc

SEQ ID NO: 16542 - RNA, 19 nt, Artificial Sequence
  Synthetic oligonucleotide
cuuuacauuggccauuucu

SEQ ID NO: 16543 - RNA, 19 nt, Artificial Sequence
  Synthetic oligonucleotide
uuuacauuggccauuucug

SEQ ID NO: 16544 - RNA, 19 nt, Artificial Sequence
  Synthetic oligonucleotide
uuacauuggccauuucugc

SEQ ID NO: 16545 - RNA, 19 nt, Artificial Sequence
  Synthetic oligonucleotide
uaugcucuuucccugggag

SEQ ID NO: 16546 - RNA, 19 nt, Artificial Sequence
  Synthetic oligonucleotide
augcucuuucccugggaga

SEQ ID NO: 16547 - RNA, 19 nt, Artificial Sequence
  Synthetic oligonucleotide
ugcucuuucccugggagau

SEQ ID NO: 16548 - RNA, 19 nt, Artificial Sequence
  Synthetic oligonucleotide
gcucuuucccugggagaua

SEQ ID NO: 16549 - RNA, 19 nt, Artificial Sequence
  Synthetic oligonucleotide
cucuuucccugggagauaa

SEQ ID NO: 16550 - RNA, 19 nt, Artificial Sequence
  Synthetic oligonucleotide
ucuuucccugggagauaaa

SEQ ID NO: 16551 - RNA, 19 nt, Artificial Sequence
  Synthetic oligonucleotide
cuuucccugggagauaaaa

SEQ ID NO: 16552 - RNA, 19 nt, Artificial Sequence
  Synthetic oligonucleotide
uuucccugggagauaaaac

SEQ ID NO: 16553 - RNA, 19 nt, Artificial Sequence
  Synthetic oligonucleotide
uucccugggagauaaaacu

SEQ ID NO: 16554 - RNA, 19 nt, Artificial Sequence
  Synthetic oligonucleotide
ucccugggagauaaaacuc

SEQ ID NO: 16555 - RNA, 19 nt, Artificial Sequence
  Synthetic oligonucleotide
cccugggagauaaaacuca

SEQ ID NO: 16556 - RNA, 19 nt, Artificial Sequence
  Synthetic oligonucleotide
ccugggagauaaaacucac

SEQ ID NO: 16557 - RNA, 19 nt, Artificial Sequence
  Synthetic oligonucleotide
cugggagauaaaacucacc

SEQ ID NO: 16558 - RNA, 19 nt, Artificial Sequence
  Synthetic oligonucleotide
ugggagauaaaacucaccc

SEQ ID NO: 16559 - RNA, 19 nt, Artificial Sequence
  Synthetic oligonucleotide
gggagauaaaacucaccca

SEQ ID NO: 16560 - RNA, 19 nt, Artificial Sequence
  Synthetic oligonucleotide
ggagauaaaacucacccac

SEQ ID NO: 16561 - RNA, 19 nt, Artificial Sequence
  Synthetic oligonucleotide
gagauaaaacucacccaca

SEQ ID NO: 16562 - RNA, 19 nt, Artificial Sequence
  Synthetic oligonucleotide
agauaaaacucacccacag

SEQ ID NO: 16563 - RNA, 19 nt, Artificial Sequence
  Synthetic oligonucleotide
gauaaaacucacccacagu

SEQ ID NO: 16564 - RNA, 19 nt, Artificial Sequence
  Synthetic oligonucleotide
auaaaacucacccacaguu

SEQ ID NO: 16565 - RNA, 19 nt, Artificial Sequence
  Synthetic oligonucleotide
uaaaacucacccacaguuu

SEQ ID NO: 16566 - RNA, 19 nt, Artificial Sequence
  Synthetic oligonucleotide
guucaauuguuucagcuuu

SEQ ID NO: 16567 - RNA, 19 nt, Artificial Sequence
  Synthetic oligonucleotide
ucaauuguuucagcuuuga

SEQ ID NO: 16568 - RNA, 19 nt, Artificial Sequence
  Synthetic oligonucleotide
caauuguuucagcuuugaa

SEQ ID NO: 16569 - RNA, 19 nt, Artificial Sequence
  Synthetic oligonucleotide
aauuguuucagcuuugaag

SEQ ID NO: 16570 - RNA, 19 nt, Artificial Sequence
  Synthetic oligonucleotide
auuguuucagcuuugaaga

SEQ ID NO: 16571 - RNA, 19 nt, Artificial Sequence
  Synthetic oligonucleotide
uuguuucagcuuugaagag

SEQ ID NO: 16572 - RNA, 19 nt, Artificial Sequence
  Synthetic oligonucleotide
uguuucagcuuugaagaga

SEQ ID NO: 16573 - RNA, 19 nt, Artificial Sequence
  Synthetic oligonucleotide
guuucagcuuugaagagag

SEQ ID NO: 16574 - RNA, 19 nt, Artificial Sequence
  Synthetic oligonucleotide
uuucagcuuugaagagaga

SEQ ID NO: 16575 - RNA, 19 nt, Artificial Sequence
  Synthetic oligonucleotide
uucagcuuugaagagagaa

SEQ ID NO: 16576 - RNA, 19 nt, Artificial Sequence
  Synthetic oligonucleotide
ucagcuuugaagagagaag

SEQ ID NO: 16577 - RNA, 19 nt, Artificial Sequence
  Synthetic oligonucleotide
cagcuuugaagagagaagc

SEQ ID NO: 16578 - RNA, 19 nt, Artificial Sequence
  Synthetic oligonucleotide
agcuuugaagagagaagcu

SEQ ID NO: 16579 - RNA, 19 nt, Artificial Sequence
  Synthetic oligonucleotide
gcuuugaagagagaagcuu

SEQ ID NO: 16580 - RNA, 19 nt, Artificial Sequence
  Synthetic oligonucleotide
cuuugaagagagaagcuuu

SEQ ID NO: 16581 - RNA, 19 nt, Artificial Sequence
  Synthetic oligonucleotide
uuugaagagagaagcuuug

SEQ ID NO: 16582 - RNA, 19 nt, Artificial Sequence
  Synthetic oligonucleotide
uugaagagagaagcuuugg

SEQ ID NO: 16583 - RNA, 19 nt, Artificial Sequence
  Synthetic oligonucleotide
ugaagagagaagcuuuggu

SEQ ID NO: 16584 - RNA, 19 nt, Artificial Sequence
  Synthetic oligonucleotide
gagagaagcuuugguuaaa

SEQ ID NO: 16585 - RNA, 19 nt, Artificial Sequence
  Synthetic oligonucleotide
agagaagcuuugguuaaag

SEQ ID NO: 16586 - RNA, 19 nt, Artificial Sequence
  Synthetic oligonucleotide
gagaagcuuugguuaaagg

SEQ ID NO: 16587 - RNA, 19 nt, Artificial Sequence
  Synthetic oligonucleotide
aagcuuugguuaaagguaa

SEQ ID NO: 16588 - RNA, 19 nt, Artificial Sequence
  Synthetic oligonucleotide
agcuuugguuaaagguaau

SEQ ID NO: 16589 - RNA, 19 nt, Artificial Sequence
  Synthetic oligonucleotide
gcuuugguuaaagguaauc

SEQ ID NO: 16590 - RNA, 19 nt, Artificial Sequence
  Synthetic oligonucleotide
cuuugguuaaagguaaucc

SEQ ID NO: 16591 - RNA, 19 nt, Artificial Sequence
  Synthetic oligonucleotide
uuugguuaaagguaaucca

SEQ ID NO: 16592 - RNA, 19 nt, Artificial Sequence
  Synthetic oligonucleotide
uugguuaaagguaauccac

SEQ ID NO: 16593 - RNA, 19 nt, Artificial Sequence
  Synthetic oligonucleotide
ugguuaaagguaauccacc

SEQ ID NO: 16594 - RNA, 19 nt, Artificial Sequence
  Synthetic oligonucleotide
gguuaaagguaauccaccc

SEQ ID NO: 16595 - RNA, 19 nt, Artificial Sequence
  Synthetic oligonucleotide
guuaaagguaauccaccca

SEQ ID NO: 16596 - RNA, 19 nt, Artificial Sequence
  Synthetic oligonucleotide
uuaaagguaauccacccau

SEQ ID NO: 16597 - RNA, 19 nt, Artificial Sequence
  Synthetic oligonucleotide
uaaagguaauccacccauu

SEQ ID NO: 16598 - RNA, 19 nt, Artificial Sequence
  Synthetic oligonucleotide
aaagguaauccacccauuu

SEQ ID NO: 16599 - RNA, 19 nt, Artificial Sequence
  Synthetic oligonucleotide
aagguaauccacccauuua

SEQ ID NO: 16600 - RNA, 19 nt, Artificial Sequence
  Synthetic oligonucleotide
agguaauccacccauuuau

SEQ ID NO: 16601 - RNA, 19 nt, Artificial Sequence
  Synthetic oligonucleotide
gguaauccacccauuuauc

SEQ ID NO: 16602 - RNA, 19 nt, Artificial Sequence
  Synthetic oligonucleotide
guaauccacccauuuaucg

SEQ ID NO: 16603 - RNA, 19 nt, Artificial Sequence
  Synthetic oligonucleotide
uaauccacccauuuaucgu

SEQ ID NO: 16604 - RNA, 19 nt, Artificial Sequence
  Synthetic oligonucleotide
aauccacccauuuaucguu

SEQ ID NO: 16605 - RNA, 19 nt, Artificial Sequence
  Synthetic oligonucleotide
auccacccauuuaucguuu

SEQ ID NO: 16606 - RNA, 19 nt, Artificial Sequence
  Synthetic oligonucleotide
uccacccauuuaucguuuu

SEQ ID NO: 16607 - RNA, 19 nt, Artificial Sequence
  Synthetic oligonucleotide
ccacccauuuaucguuuuu

SEQ ID NO: 16608 - RNA, 19 nt, Artificial Sequence
  Synthetic oligonucleotide
cacccauuuaucguuuuug

SEQ ID NO: 16609 - RNA, 19 nt, Artificial Sequence
  Synthetic oligonucleotide
acccauuuaucguuuuugg

SEQ ID NO: 16610 - RNA, 19 nt, Artificial Sequence
  Synthetic oligonucleotide
cccauuuaucguuuuugga

SEQ ID NO: 16611 - RNA, 19 nt, Artificial Sequence
  Synthetic oligonucleotide
cauuuaucguuuuuggaaa

SEQ ID NO: 16612 - RNA, 19 nt, Artificial Sequence
  Synthetic oligonucleotide
auuuaucguuuuuggaaag

SEQ ID NO: 16613 - RNA, 19 nt, Artificial Sequence
  Synthetic oligonucleotide
uuuaucguuuuuggaaaga

SEQ ID NO: 16614 - RNA, 19 nt, Artificial Sequence
  Synthetic oligonucleotide
uuaucguuuuuggaaagac

SEQ ID NO: 16615 - RNA, 19 nt, Artificial Sequence
  Synthetic oligonucleotide
uaucguuuuuggaaagaca

SEQ ID NO: 16616 - RNA, 19 nt, Artificial Sequence
  Synthetic oligonucleotide
cauaaagacagcucuguac

SEQ ID NO: 16617 - RNA, 19 nt, Artificial Sequence
  Synthetic oligonucleotide
auaaagacagcucuguacc

SEQ ID NO: 16618 - RNA, 19 nt, Artificial Sequence
  Synthetic oligonucleotide
uaaagacagcucuguaccu

SEQ ID NO: 16619 - RNA, 19 nt, Artificial Sequence
  Synthetic oligonucleotide
aaagacagcucuguaccua

SEQ ID NO: 16620 - RNA, 19 nt, Artificial Sequence
  Synthetic oligonucleotide
aagacagcucuguaccuaa

SEQ ID NO: 16621 - RNA, 19 nt, Artificial Sequence
  Synthetic oligonucleotide
agacagcucuguaccuaac

SEQ ID NO: 16622 - RNA, 19 nt, Artificial Sequence
  Synthetic oligonucleotide
gacagcucuguaccuaaca

SEQ ID NO: 16623 - RNA, 19 nt, Artificial Sequence
  Synthetic oligonucleotide
acagcucuguaccuaacac

SEQ ID NO: 16624 - RNA, 19 nt, Artificial Sequence
  Synthetic oligonucleotide
cagcucuguaccuaacacu

SEQ ID NO: 16625 - RNA, 19 nt, Artificial Sequence
  Synthetic oligonucleotide
agcucuguaccuaacacug

SEQ ID NO: 16626 - RNA, 19 nt, Artificial Sequence
  Synthetic oligonucleotide
gcucuguaccuaacacugg

SEQ ID NO: 16627 - RNA, 19 nt, Artificial Sequence
  Synthetic oligonucleotide
cucuguaccuaacacuggu

SEQ ID NO: 16628 - RNA, 19 nt, Artificial Sequence
  Synthetic oligonucleotide
ucuguaccuaacacuggua

SEQ ID NO: 16629 - RNA, 19 nt, Artificial Sequence
  Synthetic oligonucleotide
cuguaccuaacacugguac

SEQ ID NO: 16630 - RNA, 19 nt, Artificial Sequence
  Synthetic oligonucleotide
gcacguaugguagaaacaa

SEQ ID NO: 16631 - RNA, 19 nt, Artificial Sequence
  Synthetic oligonucleotide
cacguaugguagaaacaac

SEQ ID NO: 16632 - RNA, 19 nt, Artificial Sequence
  Synthetic oligonucleotide
acguaugguagaaacaacu

SEQ ID NO: 16633 - RNA, 19 nt, Artificial Sequence
  Synthetic oligonucleotide
cguaugguagaaacaacug

SEQ ID NO: 16634 - RNA, 19 nt, Artificial Sequence
  Synthetic oligonucleotide
guaugguagaaacaacugc

SEQ ID NO: 16635 - RNA, 19 nt, Artificial Sequence
  Synthetic oligonucleotide
uaugguagaaacaacugcc

SEQ ID NO: 16636 - RNA, 19 nt, Artificial Sequence
  Synthetic oligonucleotide
augguagaaacaacugccu

SEQ ID NO: 16637 - RNA, 19 nt, Artificial Sequence
  Synthetic oligonucleotide
ugguagaaacaacugccua

SEQ ID NO: 16638 - RNA, 19 nt, Artificial Sequence
  Synthetic oligonucleotide
gguagaaacaacugccuau

SEQ ID NO: 16639 - RNA, 19 nt, Artificial Sequence
  Synthetic oligonucleotide
guagaaacaacugccuaug

SEQ ID NO: 16640 - RNA, 19 nt, Artificial Sequence
  Synthetic oligonucleotide
uagaaacaacugccuaugc

SEQ ID NO: 16641 - RNA, 19 nt, Artificial Sequence
  Synthetic oligonucleotide
agaaacaacugccuaugcu

SEQ ID NO: 16642 - RNA, 19 nt, Artificial Sequence
  Synthetic oligonucleotide
gaaacaacugccuaugcuu

SEQ ID NO: 16643 - RNA, 19 nt, Artificial Sequence
  Synthetic oligonucleotide
aaacaacugccuaugcuuu

SEQ ID NO: 16644 - RNA, 19 nt, Artificial Sequence
  Synthetic oligonucleotide
aacaacugccuaugcuuua

SEQ ID NO: 16645 - RNA, 19 nt, Artificial Sequence
  Synthetic oligonucleotide
acaacugccuaugcuuuac

SEQ ID NO: 16646 - RNA, 19 nt, Artificial Sequence
  Synthetic oligonucleotide
caacugccuaugcuuuacu

SEQ ID NO: 16647 - RNA, 19 nt, Artificial Sequence
  Synthetic oligonucleotide
aacugccuaugcuuuacuc

SEQ ID NO: 16648 - RNA, 19 nt, Artificial Sequence
  Synthetic oligonucleotide
acugccuaugcuuuacuca

SEQ ID NO: 16649 - RNA, 19 nt, Artificial Sequence
  Synthetic oligonucleotide
cugccuaugcuuuacucac

SEQ ID NO: 16650 - RNA, 19 nt, Artificial Sequence
  Synthetic oligonucleotide
ugccuaugcuuuacucacc

SEQ ID NO: 16651 - RNA, 19 nt, Artificial Sequence
  Synthetic oligonucleotide
gccuaugcuuuacucacca

SEQ ID NO: 16652 - RNA, 19 nt, Artificial Sequence
  Synthetic oligonucleotide
ccuaugcuuuacucaccag

SEQ ID NO: 16653 - RNA, 19 nt, Artificial Sequence
  Synthetic oligonucleotide
cuaugcuuuacucaccagu

SEQ ID NO: 16654 - RNA, 19 nt, Artificial Sequence
  Synthetic oligonucleotide
uaugcuuuacucaccaguc

SEQ ID NO: 16655 - RNA, 19 nt, Artificial Sequence
  Synthetic oligonucleotide
augcuuuacucaccagucu

SEQ ID NO: 16656 - RNA, 19 nt, Artificial Sequence
  Synthetic oligonucleotide
ugcuuuacucaccagucug

SEQ ID NO: 16657 - RNA, 19 nt, Artificial Sequence
  Synthetic oligonucleotide
uuuacucaccagucugaac

SEQ ID NO: 16658 - RNA, 19 nt, Artificial Sequence
  Synthetic oligonucleotide
uuacucaccagucugaacu

SEQ ID NO: 16659 - RNA, 19 nt, Artificial Sequence
  Synthetic oligonucleotide
uacucaccagucugaacuu

SEQ ID NO: 16660 - RNA, 19 nt, Artificial Sequence
  Synthetic oligonucleotide
acucaccagucugaacuug

SEQ ID NO: 16661 - RNA, 19 nt, Artificial Sequence
  Synthetic oligonucleotide
ucaccagucugaacuugaa

SEQ ID NO: 16662 - RNA, 19 nt, Artificial Sequence
  Synthetic oligonucleotide
caccagucugaacuugaaa

SEQ ID NO: 16663 - RNA, 19 nt, Artificial Sequence
  Synthetic oligonucleotide
accagucugaacuugaaag

SEQ ID NO: 16664 - RNA, 19 nt, Artificial Sequence
  Synthetic oligonucleotide
ucaucaaauggcuaucaga

SEQ ID NO: 16665 - RNA, 19 nt, Artificial Sequence
  Synthetic oligonucleotide
caucaaauggcuaucagaa

SEQ ID NO: 16666 - RNA, 19 nt, Artificial Sequence
  Synthetic oligonucleotide
aucaaauggcuaucagaag

SEQ ID NO: 16667 - RNA, 19 nt, Artificial Sequence
  Synthetic oligonucleotide
ucaaauggcuaucagaaga

SEQ ID NO: 16668 - RNA, 19 nt, Artificial Sequence
  Synthetic oligonucleotide
caaauggcuaucagaagag

SEQ ID NO: 16669 - RNA, 19 nt, Artificial Sequence
  Synthetic oligonucleotide
aaauggcuaucagaagagc

SEQ ID NO: 16670 - RNA, 19 nt, Artificial Sequence
  Synthetic oligonucleotide
aauggcuaucagaagagca

SEQ ID NO: 16671 - RNA, 19 nt, Artificial Sequence
  Synthetic oligonucleotide
auggcuaucagaagagcag

SEQ ID NO: 16672 - RNA, 19 nt, Artificial Sequence
  Synthetic oligonucleotide
uggcuaucagaagagcaga

SEQ ID NO: 16673 - RNA, 19 nt, Artificial Sequence
  Synthetic oligonucleotide
ggcuaucagaagagcagag

SEQ ID NO: 16674 - RNA, 19 nt, Artificial Sequence
  Synthetic oligonucleotide
gcuaucagaagagcagagg

SEQ ID NO: 16675 - RNA, 19 nt, Artificial Sequence
  Synthetic oligonucleotide
cuaucagaagagcagaggu

SEQ ID NO: 16676 - RNA, 19 nt, Artificial Sequence
  Synthetic oligonucleotide
uaucagaagagcagaggua

SEQ ID NO: 16677 - RNA, 19 nt, Artificial Sequence
  Synthetic oligonucleotide
aucagaagagcagagguau

SEQ ID NO: 16678 - RNA, 19 nt, Artificial Sequence
  Synthetic oligonucleotide
ucagaagagcagagguaug

SEQ ID NO: 16679 - RNA, 19 nt, Artificial Sequence
  Synthetic oligonucleotide
cagaagagcagagguaugg

SEQ ID NO: 16680 - RNA, 19 nt, Artificial Sequence
  Synthetic oligonucleotide
agaagagcagagguaugga

SEQ ID NO: 16681 - RNA, 19 nt, Artificial Sequence
  Synthetic oligonucleotide
agagcagagguauggaggu

SEQ ID NO: 16682 - RNA, 19 nt, Artificial Sequence
  Synthetic oligonucleotide
gagcagagguauggaggug

SEQ ID NO: 16683 - RNA, 19 nt, Artificial Sequence
  Synthetic oligonucleotide
agcagagguauggaggugg

SEQ ID NO: 16684 - RNA, 19 nt, Artificial Sequence
  Synthetic oligonucleotide
gcagagguauggagguggc

SEQ ID NO: 16685 - RNA, 19 nt, Artificial Sequence
  Synthetic oligonucleotide
cagagguauggagguggcu

SEQ ID NO: 16686 - RNA, 19 nt, Artificial Sequence
  Synthetic oligonucleotide
agagguauggagguggcuu

SEQ ID NO: 16687 - RNA, 19 nt, Artificial Sequence
  Synthetic oligonucleotide
gagguauggagguggcuuu

SEQ ID NO: 16688 - RNA, 19 nt, Artificial Sequence
  Synthetic oligonucleotide
agguauggagguggcuuuu

SEQ ID NO: 16689 - RNA, 19 nt, Artificial Sequence
  Synthetic oligonucleotide
gguauggagguggcuuuua

SEQ ID NO: 16690 - RNA, 19 nt, Artificial Sequence
  Synthetic oligonucleotide
guauggagguggcuuuuau

SEQ ID NO: 16691 - RNA, 19 nt, Artificial Sequence
  Synthetic oligonucleotide
uauggagguggcuuuuauu

SEQ ID NO: 16692 - RNA, 19 nt, Artificial Sequence
  Synthetic oligonucleotide
auggagguggcuuuuauuc

SEQ ID NO: 16693 - RNA, 19 nt, Artificial Sequence
  Synthetic oligonucleotide
uggagguggcuuuuauuca

SEQ ID NO: 16694 - RNA, 19 nt, Artificial Sequence
  Synthetic oligonucleotide
ggagguggcuuuuauucaa

SEQ ID NO: 16695 - RNA, 19 nt, Artificial Sequence
  Synthetic oligonucleotide
gagguggcuuuuauucaac

SEQ ID NO: 16696 - RNA, 19 nt, Artificial Sequence
  Synthetic oligonucleotide
agguggcuuuuauucaacc

SEQ ID NO: 16697 - RNA, 19 nt, Artificial Sequence
  Synthetic oligonucleotide
gguggcuuuuauucaaccc

SEQ ID NO: 16698 - RNA, 19 nt, Artificial Sequence
  Synthetic oligonucleotide
guggcuuuuauucaaccca

SEQ ID NO: 16699 - RNA, 19 nt, Artificial Sequence
  Synthetic oligonucleotide
aauauucacuccugguuaa

SEQ ID NO: 16700 - RNA, 19 nt, Artificial Sequence
  Synthetic oligonucleotide
auauucacuccugguuaaa

SEQ ID NO: 16701 - RNA, 19 nt, Artificial Sequence
  Synthetic oligonucleotide
uauucacuccugguuaaac

SEQ ID NO: 16702 - RNA, 19 nt, Artificial Sequence
  Synthetic oligonucleotide
auucacuccugguuaaaca

SEQ ID NO: 16703 - RNA, 19 nt, Artificial Sequence
  Synthetic oligonucleotide
cuuacauaauuauaaaaug

SEQ ID NO: 16704 - RNA, 19 nt, Artificial Sequence
  Synthetic oligonucleotide
uuacauaauuauaaaauga

SEQ ID NO: 16705 - RNA, 19 nt, Artificial Sequence
  Synthetic oligonucleotide
uacauaauuauaaaaugac

SEQ ID NO: 16706 - RNA, 19 nt, Artificial Sequence
  Synthetic oligonucleotide
acauaauuauaaaaugaca

SEQ ID NO: 16707 - RNA, 19 nt, Artificial Sequence
  Synthetic oligonucleotide
cauaauuauaaaaugacag

SEQ ID NO: 16708 - RNA, 19 nt, Artificial Sequence
  Synthetic oligonucleotide
auaauuauaaaaugacaga

SEQ ID NO: 16709 - RNA, 19 nt, Artificial Sequence
  Synthetic oligonucleotide
uaauuauaaaaugacagac

SEQ ID NO: 16710 - RNA, 19 nt, Artificial Sequence
  Synthetic oligonucleotide
aauuauaaaaugacagaca

SEQ ID NO: 16711 - RNA, 19 nt, Artificial Sequence
  Synthetic oligonucleotide
auuauaaaaugacagacaa

SEQ ID NO: 16712 - RNA, 19 nt, Artificial Sequence
  Synthetic oligonucleotide
uuauaaaaugacagacaag

SEQ ID NO: 16713 - RNA, 19 nt, Artificial Sequence
  Synthetic oligonucleotide
uauaaaaugacagacaaga

SEQ ID NO: 16714 - RNA, 19 nt, Artificial Sequence
  Synthetic oligonucleotide
auaaaaugacagacaagaa

SEQ ID NO: 16715 - RNA, 19 nt, Artificial Sequence
  Synthetic oligonucleotide
uaaaaugacagacaagaau

SEQ ID NO: 16716 - RNA, 19 nt, Artificial Sequence
  Synthetic oligonucleotide
aaaaugacagacaagaauu

SEQ ID NO: 16717 - RNA, 19 nt, Artificial Sequence
  Synthetic oligonucleotide
aaaugacagacaagaauuu

SEQ ID NO: 16718 - RNA, 19 nt, Artificial Sequence
  Synthetic oligonucleotide
aaugacagacaagaauuuc

SEQ ID NO: 16719 - RNA, 19 nt, Artificial Sequence
  Synthetic oligonucleotide
augacagacaagaauuucc

SEQ ID NO: 16720 - RNA, 19 nt, Artificial Sequence
  Synthetic oligonucleotide
ugacagacaagaauuuccu

SEQ ID NO: 16721 - RNA, 19 nt, Artificial Sequence
  Synthetic oligonucleotide
gacagacaagaauuuccuu

SEQ ID NO: 16722 - RNA, 19 nt, Artificial Sequence
  Synthetic oligonucleotide
acagacaagaauuuccuug

SEQ ID NO: 16723 - RNA, 19 nt, Artificial Sequence
  Synthetic oligonucleotide
cagacaagaauuuccuugg

SEQ ID NO: 16724 - RNA, 19 nt, Artificial Sequence
  Synthetic oligonucleotide
agacaagaauuuccuuggg

SEQ ID NO: 16725 - RNA, 19 nt, Artificial Sequence
  Synthetic oligonucleotide
gacaagaauuuccuuggga

SEQ ID NO: 16726 - RNA, 19 nt, Artificial Sequence
  Synthetic oligonucleotide
acaagaauuuccuugggag

SEQ ID NO: 16727 - RNA, 19 nt, Artificial Sequence
  Synthetic oligonucleotide
caagaauuuccuugggagg

SEQ ID NO: 16728 - RNA, 19 nt, Artificial Sequence
  Synthetic oligonucleotide
aagaauuuccuugggaggc

SEQ ID NO: 16729 - RNA, 19 nt, Artificial Sequence
  Synthetic oligonucleotide
agaauuuccuugggaggcc

SEQ ID NO: 16730 - RNA, 19 nt, Artificial Sequence
  Synthetic oligonucleotide
gaauuuccuugggaggcca

SEQ ID NO: 16731 - RNA, 19 nt, Artificial Sequence
  Synthetic oligonucleotide
cuugggaggccaguagagg

SEQ ID NO: 16732 - RNA, 19 nt, Artificial Sequence
  Synthetic oligonucleotide
gggaggccaguagaggugc

SEQ ID NO: 16733 - RNA, 19 nt, Artificial Sequence
  Synthetic oligonucleotide
ggaggccaguagaggugcu

SEQ ID NO: 16734 - RNA, 19 nt, Artificial Sequence
  Synthetic oligonucleotide
gaggccaguagaggugcuu

SEQ ID NO: 16735 - RNA, 19 nt, Artificial Sequence
  Synthetic oligonucleotide
aggccaguagaggugcuuc

SEQ ID NO: 16736 - RNA, 19 nt, Artificial Sequence
  Synthetic oligonucleotide
ggccaguagaggugcuucu

SEQ ID NO: 16737 - RNA, 19 nt, Artificial Sequence
  Synthetic oligonucleotide
gccaguagaggugcuucuc

SEQ ID NO: 16738 - RNA, 19 nt, Artificial Sequence
  Synthetic oligonucleotide
ccaguagaggugcuucuca

SEQ ID NO: 16739 - RNA, 19 nt, Artificial Sequence
  Synthetic oligonucleotide
caguagaggugcuucucaa

SEQ ID NO: 16740 - RNA, 19 nt, Artificial Sequence
  Synthetic oligonucleotide
aguagaggugcuucucaau

SEQ ID NO: 16741 - RNA, 19 nt, Artificial Sequence
  Synthetic oligonucleotide
guagaggugcuucucaaug

SEQ ID NO: 16742 - RNA, 19 nt, Artificial Sequence
  Synthetic oligonucleotide
uagaggugcuucucaauga

SEQ ID NO: 16743 - RNA, 19 nt, Artificial Sequence
  Synthetic oligonucleotide
agaggugcuucucaaugau

SEQ ID NO: 16744 - RNA, 19 nt, Artificial Sequence
  Synthetic oligonucleotide
gaggugcuucucaaugaug

SEQ ID NO: 16745 - RNA, 19 nt, Artificial Sequence
  Synthetic oligonucleotide
aggugcuucucaaugauga

SEQ ID NO: 16746 - RNA, 19 nt, Artificial Sequence
  Synthetic oligonucleotide
ggugcuucucaaugaugac

SEQ ID NO: 16747 - RNA, 19 nt, Artificial Sequence
  Synthetic oligonucleotide
gugcuucucaaugaugacc

SEQ ID NO: 16748 - RNA, 19 nt, Artificial Sequence
  Synthetic oligonucleotide
ugcuucucaaugaugaccu

SEQ ID NO: 16749 - RNA, 19 nt, Artificial Sequence
  Synthetic oligonucleotide
gcuucucaaugaugaccuc

SEQ ID NO: 16750 - RNA, 19 nt, Artificial Sequence
  Synthetic oligonucleotide
uugucaguacaggauuugg

SEQ ID NO: 16751 - RNA, 19 nt, Artificial Sequence
  Synthetic oligonucleotide
ugucaguacaggauuuggc

SEQ ID NO: 16752 - RNA, 19 nt, Artificial Sequence
  Synthetic oligonucleotide
gucaguacaggauuuggca

SEQ ID NO: 16753 - RNA, 19 nt, Artificial Sequence
  Synthetic oligonucleotide
ucaguacaggauuuggcag

SEQ ID NO: 16754 - RNA, 19 nt, Artificial Sequence
  Synthetic oligonucleotide
caguacaggauuuggcagu

SEQ ID NO: 16755 - RNA, 19 nt, Artificial Sequence
  Synthetic oligonucleotide
aguacaggauuuggcagug

SEQ ID NO: 16756 - RNA, 19 nt, Artificial Sequence
  Synthetic oligonucleotide
guacaggauuuggcagugg

SEQ ID NO: 16757 - RNA, 19 nt, Artificial Sequence
  Synthetic oligonucleotide
uacaggauuuggcaguggc

SEQ ID NO: 16758 - RNA, 19 nt, Artificial Sequence
  Synthetic oligonucleotide
acaggauuuggcaguggcu

SEQ ID NO: 16759 - RNA, 19 nt, Artificial Sequence
  Synthetic oligonucleotide
caggauuuggcaguggcuu

SEQ ID NO: 16760 - RNA, 19 nt, Artificial Sequence
  Synthetic oligonucleotide
aggauuuggcaguggcuug

SEQ ID NO: 16761 - RNA, 19 nt, Artificial Sequence
  Synthetic oligonucleotide
gauuuggcaguggcuuggc

SEQ ID NO: 16762 - RNA, 19 nt, Artificial Sequence
  Synthetic oligonucleotide
auuuggcaguggcuuggcu

SEQ ID NO: 16763 - RNA, 19 nt, Artificial Sequence
  Synthetic oligonucleotide
uuuggcaguggcuuggcua

SEQ ID NO: 16764 - RNA, 19 nt, Artificial Sequence
  Synthetic oligonucleotide
uuggcaguggcuuggcuac

SEQ ID NO: 16765 - RNA, 19 nt, Artificial Sequence
  Synthetic oligonucleotide
guacauguaacaacuguag

SEQ ID NO: 16766 - RNA, 19 nt, Artificial Sequence
  Synthetic oligonucleotide
uacauguaacaacuguagu

SEQ ID NO: 16767 - RNA, 19 nt, Artificial Sequence
  Synthetic oligonucleotide
acauguaacaacuguaguu

SEQ ID NO: 16768 - RNA, 19 nt, Artificial Sequence
  Synthetic oligonucleotide
auguaacaacuguaguuca

SEQ ID NO: 16769 - RNA, 19 nt, Artificial Sequence
  Synthetic oligonucleotide
uguaacaacuguaguucac

SEQ ID NO: 16770 - RNA, 19 nt, Artificial Sequence
  Synthetic oligonucleotide
guaacaacuguaguucaca

SEQ ID NO: 16771 - RNA, 19 nt, Artificial Sequence
  Synthetic oligonucleotide
uaacaacuguaguucacaa

SEQ ID NO: 16772 - RNA, 19 nt, Artificial Sequence
  Synthetic oligonucleotide
aacaacuguaguucacaaa

SEQ ID NO: 16773 - RNA, 19 nt, Artificial Sequence
  Synthetic oligonucleotide
acaacuguaguucacaaaa

SEQ ID NO: 16774 - RNA, 19 nt, Artificial Sequence
  Synthetic oligonucleotide
caacuguaguucacaaaac

SEQ ID NO: 16775 - RNA, 19 nt, Artificial Sequence
  Synthetic oligonucleotide
aacuguaguucacaaaacc

SEQ ID NO: 16776 - RNA, 19 nt, Artificial Sequence
  Synthetic oligonucleotide
acuguaguucacaaaacca

SEQ ID NO: 16777 - RNA, 19 nt, Artificial Sequence
  Synthetic oligonucleotide
cuguaguucacaaaaccag

SEQ ID NO: 16778 - RNA, 19 nt, Artificial Sequence
  Synthetic oligonucleotide
uguaguucacaaaaccagu

SEQ ID NO: 16779 - RNA, 19 nt, Artificial Sequence
  Synthetic oligonucleotide
guaguucacaaaaccagua

SEQ ID NO: 16780 - RNA, 19 nt, Artificial Sequence
  Synthetic oligonucleotide
uaguucacaaaaccaguac

SEQ ID NO: 16781 - RNA, 19 nt, Artificial Sequence
  Synthetic oligonucleotide
aguucacaaaaccaguacc

SEQ ID NO: 16782 - RNA, 19 nt, Artificial Sequence
  Synthetic oligonucleotide
guucacaaaaccaguaccu

SEQ ID NO: 16783 - RNA, 19 nt, Artificial Sequence
  Synthetic oligonucleotide
uucacaaaaccaguaccuc

SEQ ID NO: 16784 - RNA, 19 nt, Artificial Sequence
  Synthetic oligonucleotide
ucacaaaaccaguaccucu

SEQ ID NO: 16785 - RNA, 19 nt, Artificial Sequence
  Synthetic oligonucleotide
cacaaaaccaguaccucug

SEQ ID NO: 16786 - RNA, 19 nt, Artificial Sequence
  Synthetic oligonucleotide
acaaaaccaguaccucuga

SEQ ID NO: 16787 - RNA, 19 nt, Artificial Sequence
  Synthetic oligonucleotide
caaaaccaguaccucugag

SEQ ID NO: 16788 - RNA, 19 nt, Artificial Sequence
  Synthetic oligonucleotide
aaaaccaguaccucugagg

SEQ ID NO: 16789 - RNA, 19 nt, Artificial Sequence
  Synthetic oligonucleotide
aaaccaguaccucugagga

SEQ ID NO: 16790 - RNA, 19 nt, Artificial Sequence
  Synthetic oligonucleotide
aaccaguaccucugaggaa

SEQ ID NO: 16791 - RNA, 19 nt, Artificial Sequence
  Synthetic oligonucleotide
accaguaccucugaggaag

SEQ ID NO: 16792 - RNA, 19 nt, Artificial Sequence
  Synthetic oligonucleotide
ccaguaccucugaggaagu

SEQ ID NO: 16793 - RNA, 19 nt, Artificial Sequence
  Synthetic oligonucleotide
caguaccucugaggaaguu

SEQ ID NO: 16794 - RNA, 19 nt, Artificial Sequence
  Synthetic oligonucleotide
aguaccucugaggaaguuu

SEQ ID NO: 16795 - RNA, 19 nt, Artificial Sequence
  Synthetic oligonucleotide
guaccucugaggaaguuug

SEQ ID NO: 16796 - RNA, 19 nt, Artificial Sequence
  Synthetic oligonucleotide
uaccucugaggaaguuugc

SEQ ID NO: 16797 - RNA, 19 nt, Artificial Sequence
  Synthetic oligonucleotide
accucugaggaaguuugca

SEQ ID NO: 16798 - RNA, 19 nt, Artificial Sequence
  Synthetic oligonucleotide
ccucugaggaaguuugcag

SEQ ID NO: 16799 - RNA, 19 nt, Artificial Sequence
  Synthetic oligonucleotide
cucugaggaaguuugcagc

SEQ ID NO: 16800 - RNA, 19 nt, Artificial Sequence
  Synthetic oligonucleotide
ucugaggaaguuugcagcu

SEQ ID NO: 16801 - RNA, 19 nt, Artificial Sequence
  Synthetic oligonucleotide
cugaggaaguuugcagcuu

SEQ ID NO: 16802 - RNA, 19 nt, Artificial Sequence
  Synthetic oligonucleotide
ugaggaaguuugcagcuuu

SEQ ID NO: 16803 - RNA, 19 nt, Artificial Sequence
  Synthetic oligonucleotide
uugcagcuuuuauuugaaa

SEQ ID NO: 16804 - RNA, 19 nt, Artificial Sequence
  Synthetic oligonucleotide
ugcagcuuuuauuugaaaa

SEQ ID NO: 16805 - RNA, 19 nt, Artificial Sequence
  Synthetic oligonucleotide
gauacucaggauauugaag

SEQ ID NO: 16806 - RNA, 19 nt, Artificial Sequence
  Synthetic oligonucleotide
uacucaggauauugaagca

SEQ ID NO: 16807 - RNA, 19 nt, Artificial Sequence
  Synthetic oligonucleotide
acucaggauauugaagcau

SEQ ID NO: 16808 - RNA, 19 nt, Artificial Sequence
  Synthetic oligonucleotide
cucaggauauugaagcauc

SEQ ID NO: 16809 - RNA, 19 nt, Artificial Sequence
  Synthetic oligonucleotide
ucaggauauugaagcaucc

SEQ ID NO: 16810 - RNA, 19 nt, Artificial Sequence
  Synthetic oligonucleotide
aggauauugaagcauccca

SEQ ID NO: 16811 - RNA, 19 nt, Artificial Sequence
  Synthetic oligonucleotide
ggauauugaagcaucccac

SEQ ID NO: 16812 - RNA, 19 nt, Artificial Sequence
  Synthetic oligonucleotide
gauauugaagcaucccacu

SEQ ID NO: 16813 - RNA, 19 nt, Artificial Sequence
  Synthetic oligonucleotide
auauugaagcaucccacua

SEQ ID NO: 16814 - RNA, 19 nt, Artificial Sequence
  Synthetic oligonucleotide
uauugaagcaucccacuac

SEQ ID NO: 16815 - RNA, 19 nt, Artificial Sequence
  Synthetic oligonucleotide
auugaagcaucccacuaca

SEQ ID NO: 16816 - RNA, 19 nt, Artificial Sequence
  Synthetic oligonucleotide
uugaagcaucccacuacag

SEQ ID NO: 16817 - RNA, 19 nt, Artificial Sequence
  Synthetic oligonucleotide
ugaagcaucccacuacaga

SEQ ID NO: 16818 - RNA, 19 nt, Artificial Sequence
  Synthetic oligonucleotide
gaagcaucccacuacagag

SEQ ID NO: 16819 - RNA, 19 nt, Artificial Sequence
  Synthetic oligonucleotide
aagcaucccacuacagagg

SEQ ID NO: 16820 - RNA, 19 nt, Artificial Sequence
  Synthetic oligonucleotide
agcaucccacuacagaggc

SEQ ID NO: 16821 - RNA, 19 nt, Artificial Sequence
  Synthetic oligonucleotide
gcaucccacuacagaggcu

SEQ ID NO: 16822 - RNA, 19 nt, Artificial Sequence
  Synthetic oligonucleotide
caucccacuacagaggcua

SEQ ID NO: 16823 - RNA, 19 nt, Artificial Sequence
  Synthetic oligonucleotide
aucccacuacagaggcuac

SEQ ID NO: 16824 - RNA, 19 nt, Artificial Sequence
  Synthetic oligonucleotide
ucccacuacagaggcuacg

SEQ ID NO: 16825 - RNA, 19 nt, Artificial Sequence
  Synthetic oligonucleotide
cccacuacagaggcuacgg

SEQ ID NO: 16826 - RNA, 19 nt, Artificial Sequence
  Synthetic oligonucleotide
ccacuacagaggcuacgga

SEQ ID NO: 16827 - RNA, 19 nt, Artificial Sequence
  Synthetic oligonucleotide
cacuacagaggcuacggaa

SEQ ID NO: 16828 - RNA, 19 nt, Artificial Sequence
  Synthetic oligonucleotide
acuacagaggcuacggaaa

SEQ ID NO: 16829 - RNA, 19 nt, Artificial Sequence
  Synthetic oligonucleotide
cuacagaggcuacggaaac

SEQ ID NO: 16830 - RNA, 19 nt, Artificial Sequence
  Synthetic oligonucleotide
uacagaggcuacggaaacu

SEQ ID NO: 16831 - RNA, 19 nt, Artificial Sequence
  Synthetic oligonucleotide
acagaggcuacggaaacuc

SEQ ID NO: 16832 - RNA, 19 nt, Artificial Sequence
  Synthetic oligonucleotide
cagaggcuacggaaacucu

SEQ ID NO: 16833 - RNA, 19 nt, Artificial Sequence
  Synthetic oligonucleotide
agaggcuacggaaacucug

SEQ ID NO: 16834 - RNA, 19 nt, Artificial Sequence
  Synthetic oligonucleotide
gaggcuacggaaacucuga

SEQ ID NO: 16835 - RNA, 19 nt, Artificial Sequence
  Synthetic oligonucleotide
aggcuacggaaacucugau

SEQ ID NO: 16836 - RNA, 19 nt, Artificial Sequence
  Synthetic oligonucleotide
ggcuacggaaacucugauu

SEQ ID NO: 16837 - RNA, 19 nt, Artificial Sequence
  Synthetic oligonucleotide
gcuacggaaacucugauua

SEQ ID NO: 16838 - RNA, 19 nt, Artificial Sequence
  Synthetic oligonucleotide
cuacggaaacucugauuac

SEQ ID NO: 16839 - RNA, 19 nt, Artificial Sequence
  Synthetic oligonucleotide
uacggaaacucugauuaca

SEQ ID NO: 16840 - RNA, 19 nt, Artificial Sequence
  Synthetic oligonucleotide
acggaaacucugauuacaa

SEQ ID NO: 16841 - RNA, 19 nt, Artificial Sequence
  Synthetic oligonucleotide
cggaaacucugauuacaaa

SEQ ID NO: 16842 - RNA, 19 nt, Artificial Sequence
  Synthetic oligonucleotide
ggaaacucugauuacaaac

SEQ ID NO: 16843 - RNA, 19 nt, Artificial Sequence
  Synthetic oligonucleotide
gaaacucugauuacaaacg

SEQ ID NO: 16844 - RNA, 19 nt, Artificial Sequence
  Synthetic oligonucleotide
aaacucugauuacaaacgc

SEQ ID NO: 16845 - RNA, 19 nt, Artificial Sequence
  Synthetic oligonucleotide
aacucugauuacaaacgca

SEQ ID NO: 16846 - RNA, 19 nt, Artificial Sequence
  Synthetic oligonucleotide
acucugauuacaaacgcau

SEQ ID NO: 16847 - RNA, 19 nt, Artificial Sequence
  Synthetic oligonucleotide
cucugauuacaaacgcaua

SEQ ID NO: 16848 - RNA, 19 nt, Artificial Sequence
  Synthetic oligonucleotide
ucugauuacaaacgcauag

SEQ ID NO: 16849 - RNA, 19 nt, Artificial Sequence
  Synthetic oligonucleotide
cugauuacaaacgcauagu

SEQ ID NO: 16850 - RNA, 19 nt, Artificial Sequence
  Synthetic oligonucleotide
ugauuacaaacgcauagua

SEQ ID NO: 16851 - RNA, 19 nt, Artificial Sequence
  Synthetic oligonucleotide
gauuacaaacgcauaguag

SEQ ID NO: 16852 - RNA, 19 nt, Artificial Sequence
  Synthetic oligonucleotide
auuacaaacgcauaguagc

SEQ ID NO: 16853 - RNA, 19 nt, Artificial Sequence
  Synthetic oligonucleotide
uuacaaacgcauaguagca

SEQ ID NO: 16854 - RNA, 19 nt, Artificial Sequence
  Synthetic oligonucleotide
uacaaacgcauaguagcau

SEQ ID NO: 16855 - RNA, 19 nt, Artificial Sequence
  Synthetic oligonucleotide
acaaacgcauaguagcaug

SEQ ID NO: 16856 - RNA, 19 nt, Artificial Sequence
  Synthetic oligonucleotide
caaacgcauaguagcaugu

SEQ ID NO: 16857 - RNA, 19 nt, Artificial Sequence
  Synthetic oligonucleotide
aaacgcauaguagcaugug

SEQ ID NO: 16858 - RNA, 19 nt, Artificial Sequence
  Synthetic oligonucleotide
aacgcauaguagcaugugc

SEQ ID NO: 16859 - RNA, 19 nt, Artificial Sequence
  Synthetic oligonucleotide
acgcauaguagcaugugcc

SEQ ID NO: 16860 - RNA, 19 nt, Artificial Sequence
  Synthetic oligonucleotide
cgcauaguagcaugugcca

SEQ ID NO: 16861 - RNA, 19 nt, Artificial Sequence
  Synthetic oligonucleotide
gcauaguagcaugugccag

SEQ ID NO: 16862 - RNA, 19 nt, Artificial Sequence
  Synthetic oligonucleotide
cauaguagcaugugccagc

SEQ ID NO: 16863 - RNA, 19 nt, Artificial Sequence
  Synthetic oligonucleotide
auaguagcaugugccagcu

SEQ ID NO: 16864 - RNA, 19 nt, Artificial Sequence
  Synthetic oligonucleotide
uaguagcaugugccagcua

SEQ ID NO: 16865 - RNA, 19 nt, Artificial Sequence
  Synthetic oligonucleotide
aguagcaugugccagcuac

SEQ ID NO: 16866 - RNA, 19 nt, Artificial Sequence
  Synthetic oligonucleotide
guagcaugugccagcuaca

SEQ ID NO: 16867 - RNA, 19 nt, Artificial Sequence
  Synthetic oligonucleotide
gugauggacaucuccuugc

SEQ ID NO: 16868 - RNA, 19 nt, Artificial Sequence
  Synthetic oligonucleotide
ugauggacaucuccuugcc

SEQ ID NO: 16869 - RNA, 19 nt, Artificial Sequence
  Synthetic oligonucleotide
gauggacaucuccuugccu

SEQ ID NO: 16870 - RNA, 19 nt, Artificial Sequence
  Synthetic oligonucleotide
auggacaucuccuugccua

SEQ ID NO: 16871 - RNA, 19 nt, Artificial Sequence
  Synthetic oligonucleotide
uggacaucuccuugccuac

SEQ ID NO: 16872 - RNA, 19 nt, Artificial Sequence
  Synthetic oligonucleotide
ggacaucuccuugccuacu

SEQ ID NO: 16873 - RNA, 19 nt, Artificial Sequence
  Synthetic oligonucleotide
gacaucuccuugccuacug

SEQ ID NO: 16874 - RNA, 19 nt, Artificial Sequence
  Synthetic oligonucleotide
acaucuccuugccuacugg

SEQ ID NO: 16875 - RNA, 19 nt, Artificial Sequence
  Synthetic oligonucleotide
caucuccuugccuacugga

SEQ ID NO: 16876 - RNA, 19 nt, Artificial Sequence
  Synthetic oligonucleotide
aucuccuugccuacuggaa

SEQ ID NO: 16877 - RNA, 19 nt, Artificial Sequence
  Synthetic oligonucleotide
ucuccuugccuacuggaau

SEQ ID NO: 16878 - RNA, 19 nt, Artificial Sequence
  Synthetic oligonucleotide
cuccuugccuacuggaauc

SEQ ID NO: 16879 - RNA, 19 nt, Artificial Sequence
  Synthetic oligonucleotide
uccuugccuacuggaauca

SEQ ID NO: 16880 - RNA, 19 nt, Artificial Sequence
  Synthetic oligonucleotide
ugcaaaugaagaagacuua

SEQ ID NO: 16881 - RNA, 19 nt, Artificial Sequence
  Synthetic oligonucleotide
gcaaaugaagaagacuuaa

SEQ ID NO: 16882 - RNA, 19 nt, Artificial Sequence
  Synthetic oligonucleotide
caaaugaagaagacuuaaa

SEQ ID NO: 16883 - RNA, 19 nt, Artificial Sequence
  Synthetic oligonucleotide
aaaugaagaagacuuaaaa

SEQ ID NO: 16884 - RNA, 19 nt, Artificial Sequence
  Synthetic oligonucleotide
aaugaagaagacuuaaaag

SEQ ID NO: 16885 - RNA, 19 nt, Artificial Sequence
  Synthetic oligonucleotide
augaagaagacuuaaaagc

SEQ ID NO: 16886 - RNA, 19 nt, Artificial Sequence
  Synthetic oligonucleotide
cuuguggaagggguggauc

SEQ ID NO: 16887 - RNA, 19 nt, Artificial Sequence
  Synthetic oligonucleotide
uuguggaagggguggauca

SEQ ID NO: 16888 - RNA, 19 nt, Artificial Sequence
  Synthetic oligonucleotide
cuauucacugauuaccaaa

SEQ ID NO: 16889 - RNA, 19 nt, Artificial Sequence
  Synthetic oligonucleotide
uauucacugauuaccaaau

SEQ ID NO: 16890 - RNA, 19 nt, Artificial Sequence
  Synthetic oligonucleotide
aaagauggacauguuauuc

SEQ ID NO: 16891 - RNA, 19 nt, Artificial Sequence
  Synthetic oligonucleotide
aagauggacauguuauucu

SEQ ID NO: 16892 - RNA, 19 nt, Artificial Sequence
  Synthetic oligonucleotide
agauggacauguuauucug

SEQ ID NO: 16893 - RNA, 19 nt, Artificial Sequence
  Synthetic oligonucleotide
uggacauguuauucugcaa

SEQ ID NO: 16894 - RNA, 19 nt, Artificial Sequence
  Synthetic oligonucleotide
gacauguuauucugcaacu

SEQ ID NO: 16895 - RNA, 19 nt, Artificial Sequence
  Synthetic oligonucleotide
uguuauucugcaacugaau

SEQ ID NO: 16896 - RNA, 19 nt, Artificial Sequence
  Synthetic oligonucleotide
guuauucugcaacugaauu

SEQ ID NO: 16897 - RNA, 19 nt, Artificial Sequence
  Synthetic oligonucleotide
uuauucugcaacugaauuc

SEQ ID NO: 16898 - RNA, 19 nt, Artificial Sequence
  Synthetic oligonucleotide
uauucugcaacugaauucg

SEQ ID NO: 16899 - RNA, 19 nt, Artificial Sequence
  Synthetic oligonucleotide
uuugaacucuuugaaguug

SEQ ID NO: 16900 - RNA, 19 nt, Artificial Sequence
  Synthetic oligonucleotide
uugaacucuuugaaguugg

SEQ ID NO: 16901 - RNA, 19 nt, Artificial Sequence
  Synthetic oligonucleotide
ugaacucuuugaaguuggg

SEQ ID NO: 16902 - RNA, 19 nt, Artificial Sequence
  Synthetic oligonucleotide
gaacucuuugaaguugggu

SEQ ID NO: 16903 - RNA, 19 nt, Artificial Sequence
  Synthetic oligonucleotide
aacucuuugaaguuggguu

SEQ ID NO: 16904 - RNA, 19 nt, Artificial Sequence
  Synthetic oligonucleotide
acucuuugaaguuggguuu

SEQ ID NO: 16905 - RNA, 19 nt, Artificial Sequence
  Synthetic oligonucleotide
cucuuugaaguuggguuuc

SEQ ID NO: 16906 - RNA, 19 nt, Artificial Sequence
  Synthetic oligonucleotide
ucuuugaaguuggguuucu

SEQ ID NO: 16907 - RNA, 19 nt, Artificial Sequence
  Synthetic oligonucleotide
aguccugccacuuucacag

SEQ ID NO: 16908 - RNA, 19 nt, Artificial Sequence
  Synthetic oligonucleotide
guccugccacuuucacagu

SEQ ID NO: 16909 - RNA, 19 nt, Artificial Sequence
  Synthetic oligonucleotide
uccugccacuuucacagug

SEQ ID NO: 16910 - RNA, 19 nt, Artificial Sequence
  Synthetic oligonucleotide
ccugccacuuucacagugu

SEQ ID NO: 16911 - RNA, 19 nt, Artificial Sequence
  Synthetic oligonucleotide
cugccacuuucacagugua

SEQ ID NO: 16912 - RNA, 19 nt, Artificial Sequence
  Synthetic oligonucleotide
gaauaccacagaccagaua

SEQ ID NO: 16913 - RNA, 19 nt, Artificial Sequence
  Synthetic oligonucleotide
aauaccacagaccagauaa

SEQ ID NO: 16914 - RNA, 19 nt, Artificial Sequence
  Synthetic oligonucleotide
auaccacagaccagauaaa

SEQ ID NO: 16915 - RNA, 19 nt, Artificial Sequence
  Synthetic oligonucleotide
uaccacagaccagauaaac

SEQ ID NO: 16916 - RNA, 19 nt, Artificial Sequence
  Synthetic oligonucleotide
accacagaccagauaaaca

SEQ ID NO: 16917 - RNA, 19 nt, Artificial Sequence
  Synthetic oligonucleotide
ccacagaccagauaaacag

SEQ ID NO: 16918 - RNA, 19 nt, Artificial Sequence
  Synthetic oligonucleotide
cacagaccagauaaacagu

SEQ ID NO: 16919 - RNA, 19 nt, Artificial Sequence
  Synthetic oligonucleotide
acagaccagauaaacagug

SEQ ID NO: 16920 - RNA, 19 nt, Artificial Sequence
  Synthetic oligonucleotide
cagaccagauaaacagugu

SEQ ID NO: 16921 - RNA, 19 nt, Artificial Sequence
  Synthetic oligonucleotide
agaccagauaaacagugua

SEQ ID NO: 16922 - RNA, 19 nt, Artificial Sequence
  Synthetic oligonucleotide
gaccagauaaacaguguac

SEQ ID NO: 16923 - RNA, 19 nt, Artificial Sequence
  Synthetic oligonucleotide
accagauaaacaguguacc

SEQ ID NO: 16924 - RNA, 19 nt, Artificial Sequence
  Synthetic oligonucleotide
ccagauaaacaguguacca

SEQ ID NO: 16925 - RNA, 19 nt, Artificial Sequence
  Synthetic oligonucleotide
cagauaaacaguguaccau

SEQ ID NO: 16926 - RNA, 19 nt, Artificial Sequence
  Synthetic oligonucleotide
agauaaacaguguaccaug

SEQ ID NO: 16927 - RNA, 19 nt, Artificial Sequence
  Synthetic oligonucleotide
uaaacaguguaccauguuu

SEQ ID NO: 16928 - RNA, 19 nt, Artificial Sequence
  Synthetic oligonucleotide
aacaguguaccauguuuua

SEQ ID NO: 16929 - RNA, 19 nt, Artificial Sequence
  Synthetic oligonucleotide
caguguaccauguuuuaua

SEQ ID NO: 16930 - RNA, 19 nt, Artificial Sequence
  Synthetic oligonucleotide
aguguaccauguuuuauag

SEQ ID NO: 16931 - RNA, 19 nt, Artificial Sequence
  Synthetic oligonucleotide
guguaccauguuuuauagc

SEQ ID NO: 16932 - RNA, 19 nt, Artificial Sequence
  Synthetic oligonucleotide
uguaccauguuuuauagca

SEQ ID NO: 16933 - RNA, 19 nt, Artificial Sequence
  Synthetic oligonucleotide
guaccauguuuuauagcac

SEQ ID NO: 16934 - RNA, 19 nt, Artificial Sequence
  Synthetic oligonucleotide
uaccauguuuuauagcacu

SEQ ID NO: 16935 - RNA, 19 nt, Artificial Sequence
  Synthetic oligonucleotide
accauguuuuauagcacuu

SEQ ID NO: 16936 - RNA, 19 nt, Artificial Sequence
  Synthetic oligonucleotide
ccauguuuuauagcacuuc

SEQ ID NO: 16937 - RNA, 19 nt, Artificial Sequence
  Synthetic oligonucleotide
cauguuuuauagcacuucc

SEQ ID NO: 16938 - RNA, 19 nt, Artificial Sequence
  Synthetic oligonucleotide
auguuuuauagcacuucca

SEQ ID NO: 16939 - RNA, 19 nt, Artificial Sequence
  Synthetic oligonucleotide
uguuuuauagcacuuccaa

SEQ ID NO: 16940 - RNA, 19 nt, Artificial Sequence
  Synthetic oligonucleotide
guuuuauagcacuuccaau

SEQ ID NO: 16941 - RNA, 19 nt, Artificial Sequence
  Synthetic oligonucleotide
uuuuauagcacuuccaaua

SEQ ID NO: 16942 - RNA, 19 nt, Artificial Sequence
  Synthetic oligonucleotide
uuuauagcacuuccaauau

SEQ ID NO: 16943 - RNA, 19 nt, Artificial Sequence
  Synthetic oligonucleotide
uuauagcacuuccaauauc

SEQ ID NO: 16944 - RNA, 19 nt, Artificial Sequence
  Synthetic oligonucleotide
uauagcacuuccaauauca

SEQ ID NO: 16945 - RNA, 19 nt, Artificial Sequence
  Synthetic oligonucleotide
uagcacuuccaauaucaaa

SEQ ID NO: 16946 - RNA, 19 nt, Artificial Sequence
  Synthetic oligonucleotide
agcacuuccaauaucaaaa

SEQ ID NO: 16947 - RNA, 19 nt, Artificial Sequence
  Synthetic oligonucleotide
gcacuuccaauaucaaaau

SEQ ID NO: 16948 - RNA, 19 nt, Artificial Sequence
  Synthetic oligonucleotide
cacuuccaauaucaaaauu

SEQ ID NO: 16949 - RNA, 19 nt, Artificial Sequence
  Synthetic oligonucleotide
acuuccaauaucaaaauuc

SEQ ID NO: 16950 - RNA, 19 nt, Artificial Sequence
  Synthetic oligonucleotide
cuuccaauaucaaaauuca

SEQ ID NO: 16951 - RNA, 19 nt, Artificial Sequence
  Synthetic oligonucleotide
uuccaauaucaaaauucag

SEQ ID NO: 16952 - RNA, 19 nt, Artificial Sequence
  Synthetic oligonucleotide
uccaauaucaaaauucaga

SEQ ID NO: 16953 - RNA, 19 nt, Artificial Sequence
  Synthetic oligonucleotide
ccaauaucaaaauucagaa

SEQ ID NO: 16954 - RNA, 19 nt, Artificial Sequence
  Synthetic oligonucleotide
caauaucaaaauucagaaa

SEQ ID NO: 16955 - RNA, 19 nt, Artificial Sequence
  Synthetic oligonucleotide
aauaucaaaauucagaaag

SEQ ID NO: 16956 - RNA, 19 nt, Artificial Sequence
  Synthetic oligonucleotide
auaucaaaauucagaaagu

SEQ ID NO: 16957 - RNA, 19 nt, Artificial Sequence
  Synthetic oligonucleotide
uaucaaaauucagaaaguc

SEQ ID NO: 16958 - RNA, 19 nt, Artificial Sequence
  Synthetic oligonucleotide
aucaaaauucagaaagucu

SEQ ID NO: 16959 - RNA, 19 nt, Artificial Sequence
  Synthetic oligonucleotide
ucaaaauucagaaagucug

SEQ ID NO: 16960 - RNA, 19 nt, Artificial Sequence
  Synthetic oligonucleotide
caaaauucagaaagucugu

SEQ ID NO: 16961 - RNA, 19 nt, Artificial Sequence
  Synthetic oligonucleotide
aaaauucagaaagucugug

SEQ ID NO: 16962 - RNA, 19 nt, Artificial Sequence
  Synthetic oligonucleotide
aaauucagaaagucuguga

SEQ ID NO: 16963 - RNA, 19 nt, Artificial Sequence
  Synthetic oligonucleotide
aauucagaaagucugugaa

SEQ ID NO: 16964 - RNA, 19 nt, Artificial Sequence
  Synthetic oligonucleotide
auucagaaagucugugaag

SEQ ID NO: 16965 - RNA, 19 nt, Artificial Sequence
  Synthetic oligonucleotide
gaaagucugugaaggagcc

SEQ ID NO: 16966 - RNA, 19 nt, Artificial Sequence
  Synthetic oligonucleotide
uagaagcugauugugggca

SEQ ID NO: 16967 - RNA, 19 nt, Artificial Sequence
  Synthetic oligonucleotide
agaagcugauugugggcaa

SEQ ID NO: 16968 - RNA, 19 nt, Artificial Sequence
  Synthetic oligonucleotide
gaagcugauugugggcaaa

SEQ ID NO: 16969 - RNA, 19 nt, Artificial Sequence
  Synthetic oligonucleotide
aagcugauugugggcaaau

SEQ ID NO: 16970 - RNA, 19 nt, Artificial Sequence
  Synthetic oligonucleotide
agcugauugugggcaaaug

SEQ ID NO: 16971 - RNA, 19 nt, Artificial Sequence
  Synthetic oligonucleotide
gcugauugugggcaaaugc

SEQ ID NO: 16972 - RNA, 19 nt, Artificial Sequence
  Synthetic oligonucleotide
cugauugugggcaaaugca

SEQ ID NO: 16973 - RNA, 19 nt, Artificial Sequence
  Synthetic oligonucleotide
ugauugugggcaaaugcag

SEQ ID NO: 16974 - RNA, 19 nt, Artificial Sequence
  Synthetic oligonucleotide
aagaauuggaucugacaau

SEQ ID NO: 16975 - RNA, 19 nt, Artificial Sequence
  Synthetic oligonucleotide
agaauuggaucugacaauc

SEQ ID NO: 16976 - RNA, 19 nt, Artificial Sequence
  Synthetic oligonucleotide
gaauuggaucugacaaucu

SEQ ID NO: 16977 - RNA, 19 nt, Artificial Sequence
  Synthetic oligonucleotide
aauuggaucugacaaucuc

SEQ ID NO: 16978 - RNA, 19 nt, Artificial Sequence
  Synthetic oligonucleotide
auuggaucugacaaucucu

SEQ ID NO: 16979 - RNA, 19 nt, Artificial Sequence
  Synthetic oligonucleotide
uuggaucugacaaucucug

SEQ ID NO: 16980 - RNA, 19 nt, Artificial Sequence
  Synthetic oligonucleotide
uggaucugacaaucucugc

SEQ ID NO: 16981 - RNA, 19 nt, Artificial Sequence
  Synthetic oligonucleotide
ggaucugacaaucucugca

SEQ ID NO: 16982 - RNA, 19 nt, Artificial Sequence
  Synthetic oligonucleotide
gaucugacaaucucugcag

SEQ ID NO: 16983 - RNA, 19 nt, Artificial Sequence
  Synthetic oligonucleotide
aucugacaaucucugcaga

SEQ ID NO: 16984 - RNA, 19 nt, Artificial Sequence
  Synthetic oligonucleotide
ucugacaaucucugcagag

SEQ ID NO: 16985 - RNA, 19 nt, Artificial Sequence
  Synthetic oligonucleotide
cugacaaucucugcagaga

SEQ ID NO: 16986 - RNA, 19 nt, Artificial Sequence
  Synthetic oligonucleotide
ugacaaucucugcagagac

SEQ ID NO: 16987 - RNA, 19 nt, Artificial Sequence
  Synthetic oligonucleotide
agaaaacaaacagcaugua

SEQ ID NO: 16988 - RNA, 19 nt, Artificial Sequence
  Synthetic oligonucleotide
gaaaacaaacagcauguaa

SEQ ID NO: 16989 - RNA, 19 nt, Artificial Sequence
  Synthetic oligonucleotide
gauugcauaugcuuauaaa

SEQ ID NO: 16990 - RNA, 19 nt, Artificial Sequence
  Synthetic oligonucleotide
auugcauaugcuuauaaag

SEQ ID NO: 16991 - RNA, 19 nt, Artificial Sequence
  Synthetic oligonucleotide
uugcauaugcuuauaaagu

SEQ ID NO: 16992 - RNA, 19 nt, Artificial Sequence
  Synthetic oligonucleotide
ugcauaugcuuauaaaguu

SEQ ID NO: 16993 - RNA, 19 nt, Artificial Sequence
  Synthetic oligonucleotide
gcauaugcuuauaaaguua

SEQ ID NO: 16994 - RNA, 19 nt, Artificial Sequence
  Synthetic oligonucleotide
auguuuuugucaaguacaa

SEQ ID NO: 16995 - RNA, 19 nt, Artificial Sequence
  Synthetic oligonucleotide
uguuuuugucaaguacaag

SEQ ID NO: 16996 - RNA, 19 nt, Artificial Sequence
  Synthetic oligonucleotide
guuuuugucaaguacaagg

SEQ ID NO: 16997 - RNA, 19 nt, Artificial Sequence
  Synthetic oligonucleotide
uuuuugucaaguacaaggc

SEQ ID NO: 16998 - RNA, 19 nt, Artificial Sequence
  Synthetic oligonucleotide
uuuugucaaguacaaggca

SEQ ID NO: 16999 - RNA, 19 nt, Artificial Sequence
  Synthetic oligonucleotide
uuugucaaguacaaggcaa

SEQ ID NO: 17000 - RNA, 19 nt, Artificial Sequence
  Synthetic oligonucleotide
uugucaaguacaaggcaac

SEQ ID NO: 17001 - RNA, 19 nt, Artificial Sequence
  Synthetic oligonucleotide
ugucaaguacaaggcaacc

SEQ ID NO: 17002 - RNA, 19 nt, Artificial Sequence
  Synthetic oligonucleotide
gucaaguacaaggcaaccc

SEQ ID NO: 17003 - RNA, 19 nt, Artificial Sequence
  Synthetic oligonucleotide
ucaaguacaaggcaacccu

SEQ ID NO: 17004 - RNA, 19 nt, Artificial Sequence
  Synthetic oligonucleotide
caaguacaaggcaacccuu

SEQ ID NO: 17005 - RNA, 19 nt, Artificial Sequence
  Synthetic oligonucleotide
aaguacaaggcaacccuuc

SEQ ID NO: 17006 - RNA, 19 nt, Artificial Sequence
  Synthetic oligonucleotide
aguacaaggcaacccuucu

SEQ ID NO: 17007 - RNA, 19 nt, Artificial Sequence
  Synthetic oligonucleotide
guacaaggcaacccuucug

SEQ ID NO: 17008 - RNA, 19 nt, Artificial Sequence
  Synthetic oligonucleotide
uacaaggcaacccuucugg

SEQ ID NO: 17009 - RNA, 19 nt, Artificial Sequence
  Synthetic oligonucleotide
acaaggcaacccuucugga

SEQ ID NO: 17010 - RNA, 19 nt, Artificial Sequence
  Synthetic oligonucleotide
caaggcaacccuucuggau

SEQ ID NO: 17011 - RNA, 19 nt, Artificial Sequence
  Synthetic oligonucleotide
aaggcaacccuucuggaua

SEQ ID NO: 17012 - RNA, 19 nt, Artificial Sequence
  Synthetic oligonucleotide
aggcaacccuucuggauau

SEQ ID NO: 17013 - RNA, 19 nt, Artificial Sequence
  Synthetic oligonucleotide
ggcaacccuucuggauauc

SEQ ID NO: 17014 - RNA, 19 nt, Artificial Sequence
  Synthetic oligonucleotide
gcaacccuucuggauaucu

SEQ ID NO: 17015 - RNA, 19 nt, Artificial Sequence
  Synthetic oligonucleotide
caacccuucuggauaucua

SEQ ID NO: 17016 - RNA, 19 nt, Artificial Sequence
  Synthetic oligonucleotide
aacccuucuggauaucuac

SEQ ID NO: 17017 - RNA, 19 nt, Artificial Sequence
  Synthetic oligonucleotide
acccuucuggauaucuaca

SEQ ID NO: 17018 - RNA, 19 nt, Artificial Sequence
  Synthetic oligonucleotide
cccuucuggauaucuacaa

SEQ ID NO: 17019 - RNA, 19 nt, Artificial Sequence
  Synthetic oligonucleotide
ccuucuggauaucuacaaa

SEQ ID NO: 17020 - RNA, 19 nt, Artificial Sequence
  Synthetic oligonucleotide
cuucuggauaucuacaaaa

SEQ ID NO: 17021 - RNA, 19 nt, Artificial Sequence
  Synthetic oligonucleotide
uucuggauaucuacaaaac

SEQ ID NO: 17022 - RNA, 19 nt, Artificial Sequence
  Synthetic oligonucleotide
ucuggauaucuacaaaacu

SEQ ID NO: 17023 - RNA, 19 nt, Artificial Sequence
  Synthetic oligonucleotide
cuggauaucuacaaaacug

SEQ ID NO: 17024 - RNA, 19 nt, Artificial Sequence
  Synthetic oligonucleotide
uggauaucuacaaaacugg

SEQ ID NO: 17025 - RNA, 19 nt, Artificial Sequence
  Synthetic oligonucleotide
ggauaucuacaaaacuggg

SEQ ID NO: 17026 - RNA, 19 nt, Artificial Sequence
  Synthetic oligonucleotide
gauaucuacaaaacugggg

SEQ ID NO: 17027 - RNA, 19 nt, Artificial Sequence
  Synthetic oligonucleotide
auaucuacaaaacugggga

SEQ ID NO: 17028 - RNA, 19 nt, Artificial Sequence
  Synthetic oligonucleotide
uaucuacaaaacuggggaa

SEQ ID NO: 17029 - RNA, 19 nt, Artificial Sequence
  Synthetic oligonucleotide
aucuacaaaacuggggaag

SEQ ID NO: 17030 - RNA, 19 nt, Artificial Sequence
  Synthetic oligonucleotide
ucuacaaaacuggggaagc

SEQ ID NO: 17031 - RNA, 19 nt, Artificial Sequence
  Synthetic oligonucleotide
cuacaaaacuggggaagcu

SEQ ID NO: 17032 - RNA, 19 nt, Artificial Sequence
  Synthetic oligonucleotide
uacaaaacuggggaagcug

SEQ ID NO: 17033 - RNA, 19 nt, Artificial Sequence
  Synthetic oligonucleotide
acaaaacuggggaagcugu

SEQ ID NO: 17034 - RNA, 19 nt, Artificial Sequence
  Synthetic oligonucleotide
caaaacuggggaagcuguu

SEQ ID NO: 17035 - RNA, 19 nt, Artificial Sequence
  Synthetic oligonucleotide
aaaacuggggaagcuguug

SEQ ID NO: 17036 - RNA, 19 nt, Artificial Sequence
  Synthetic oligonucleotide
aaacuggggaagcuguugc

SEQ ID NO: 17037 - RNA, 19 nt, Artificial Sequence
  Synthetic oligonucleotide
aacuggggaagcuguugcu

SEQ ID NO: 17038 - RNA, 19 nt, Artificial Sequence
  Synthetic oligonucleotide
acuggggaagcuguugcug

SEQ ID NO: 17039 - RNA, 19 nt, Artificial Sequence
  Synthetic oligonucleotide
cuggggaagcuguugcuga

SEQ ID NO: 17040 - RNA, 19 nt, Artificial Sequence
  Synthetic oligonucleotide
accuucauuaaaaagguaa

SEQ ID NO: 17041 - RNA, 19 nt, Artificial Sequence
  Synthetic oligonucleotide
ccuucauuaaaaagguaac

SEQ ID NO: 17042 - RNA, 19 nt, Artificial Sequence
  Synthetic oligonucleotide
cuucauuaaaaagguaacc

SEQ ID NO: 17043 - RNA, 19 nt, Artificial Sequence
  Synthetic oligonucleotide
uucauuaaaaagguaaccu

SEQ ID NO: 17044 - RNA, 19 nt, Artificial Sequence
  Synthetic oligonucleotide
ucauuaaaaagguaaccug

SEQ ID NO: 17045 - RNA, 19 nt, Artificial Sequence
  Synthetic oligonucleotide
aaaggaagacaguacuuaa

SEQ ID NO: 17046 - RNA, 19 nt, Artificial Sequence
  Synthetic oligonucleotide
aaggaagacaguacuuaau

SEQ ID NO: 17047 - RNA, 19 nt, Artificial Sequence
  Synthetic oligonucleotide
aggaagacaguacuuaauu

SEQ ID NO: 17048 - RNA, 19 nt, Artificial Sequence
  Synthetic oligonucleotide
ggaagacaguacuuaauua

SEQ ID NO: 17049 - RNA, 19 nt, Artificial Sequence
  Synthetic oligonucleotide
gaagacaguacuuaauuau

SEQ ID NO: 17050 - RNA, 19 nt, Artificial Sequence
  Synthetic oligonucleotide
aagacaguacuuaauuaug

SEQ ID NO: 17051 - RNA, 19 nt, Artificial Sequence
  Synthetic oligonucleotide
agacaguacuuaauuaugg

SEQ ID NO: 17052 - RNA, 19 nt, Artificial Sequence
  Synthetic oligonucleotide
gacaguacuuaauuauggg

SEQ ID NO: 17053 - RNA, 19 nt, Artificial Sequence
  Synthetic oligonucleotide
cuccagauaaaauacaauu

SEQ ID NO: 17054 - RNA, 19 nt, Artificial Sequence
  Synthetic oligonucleotide
uccagauaaaauacaauuu

SEQ ID NO: 17055 - RNA, 19 nt, Artificial Sequence
  Synthetic oligonucleotide
cagauaaaauacaauuuca

SEQ ID NO: 17056 - RNA, 19 nt, Artificial Sequence
  Synthetic oligonucleotide
uuucagguacaucuacccu

SEQ ID NO: 17057 - RNA, 19 nt, Artificial Sequence
  Synthetic oligonucleotide
uucagguacaucuacccuu

SEQ ID NO: 17058 - RNA, 19 nt, Artificial Sequence
  Synthetic oligonucleotide
ucagguacaucuacccuuu

SEQ ID NO: 17059 - RNA, 19 nt, Artificial Sequence
  Synthetic oligonucleotide
cagguacaucuacccuuua

SEQ ID NO: 17060 - RNA, 19 nt, Artificial Sequence
  Synthetic oligonucleotide
agguacaucuacccuuuag

SEQ ID NO: 17061 - RNA, 19 nt, Artificial Sequence
  Synthetic oligonucleotide
gguacaucuacccuuuaga

SEQ ID NO: 17062 - RNA, 19 nt, Artificial Sequence
  Synthetic oligonucleotide
guacaucuacccuuuagau

SEQ ID NO: 17063 - RNA, 19 nt, Artificial Sequence
  Synthetic oligonucleotide
uacaucuacccuuuagauu

SEQ ID NO: 17064 - RNA, 19 nt, Artificial Sequence
  Synthetic oligonucleotide
acaucuacccuuuagauuc

SEQ ID NO: 17065 - RNA, 19 nt, Artificial Sequence
  Synthetic oligonucleotide
caucuacccuuuagauucc

SEQ ID NO: 17066 - RNA, 19 nt, Artificial Sequence
  Synthetic oligonucleotide
aucuacccuuuagauuccu

SEQ ID NO: 17067 - RNA, 19 nt, Artificial Sequence
  Synthetic oligonucleotide
ucuacccuuuagauuccuu

SEQ ID NO: 17068 - RNA, 19 nt, Artificial Sequence
  Synthetic oligonucleotide
cuacccuuuagauuccuug

SEQ ID NO: 17069 - RNA, 19 nt, Artificial Sequence
  Synthetic oligonucleotide
uacccuuuagauuccuuga

SEQ ID NO: 17070 - RNA, 19 nt, Artificial Sequence
  Synthetic oligonucleotide
acccuuuagauuccuugac

SEQ ID NO: 17071 - RNA, 19 nt, Artificial Sequence
  Synthetic oligonucleotide
cccuuuagauuccuugacc

SEQ ID NO: 17072 - RNA, 19 nt, Artificial Sequence
  Synthetic oligonucleotide
ccuuuagauuccuugaccu

SEQ ID NO: 17073 - RNA, 19 nt, Artificial Sequence
  Synthetic oligonucleotide
cuuuagauuccuugaccug

SEQ ID NO: 17074 - RNA, 19 nt, Artificial Sequence
  Synthetic oligonucleotide
uuuagauuccuugaccugg

SEQ ID NO: 17075 - RNA, 19 nt, Artificial Sequence
  Synthetic oligonucleotide
uuagauuccuugaccugga

SEQ ID NO: 17076 - RNA, 19 nt, Artificial Sequence
  Synthetic oligonucleotide
uagauuccuugaccuggau

SEQ ID NO: 17077 - RNA, 19 nt, Artificial Sequence
  Synthetic oligonucleotide
agauuccuugaccuggauu

SEQ ID NO: 17078 - RNA, 19 nt, Artificial Sequence
  Synthetic oligonucleotide
gauuccuugaccuggauug

SEQ ID NO: 17079 - RNA, 19 nt, Artificial Sequence
  Synthetic oligonucleotide
auuccuugaccuggauuga

SEQ ID NO: 17080 - RNA, 19 nt, Artificial Sequence
  Synthetic oligonucleotide
uuccuugaccuggauugaa

SEQ ID NO: 17081 - RNA, 19 nt, Artificial Sequence
  Synthetic oligonucleotide
uccuugaccuggauugaau

SEQ ID NO: 17082 - RNA, 19 nt, Artificial Sequence
  Synthetic oligonucleotide
ccuugaccuggauugaaua

SEQ ID NO: 17083 - RNA, 19 nt, Artificial Sequence
  Synthetic oligonucleotide
cuugaccuggauugaauac

SEQ ID NO: 17084 - RNA, 19 nt, Artificial Sequence
  Synthetic oligonucleotide
uugaccuggauugaauacu

SEQ ID NO: 17085 - RNA, 19 nt, Artificial Sequence
  Synthetic oligonucleotide
ugaccuggauugaauacug

SEQ ID NO: 17086 - RNA, 19 nt, Artificial Sequence
  Synthetic oligonucleotide
gaccuggauugaauacugg

SEQ ID NO: 17087 - RNA, 19 nt, Artificial Sequence
  Synthetic oligonucleotide
accuggauugaauacuggc

SEQ ID NO: 17088 - RNA, 19 nt, Artificial Sequence
  Synthetic oligonucleotide
ccuggauugaauacuggcc

SEQ ID NO: 17089 - RNA, 19 nt, Artificial Sequence
  Synthetic oligonucleotide
cuggauugaauacuggccu

SEQ ID NO: 17090 - RNA, 19 nt, Artificial Sequence
  Synthetic oligonucleotide
uggauugaauacuggccua

SEQ ID NO: 17091 - RNA, 19 nt, Artificial Sequence
  Synthetic oligonucleotide
ggauugaauacuggccuag

SEQ ID NO: 17092 - RNA, 19 nt, Artificial Sequence
  Synthetic oligonucleotide
caacauguucaucguguca

SEQ ID NO: 17093 - RNA, 19 nt, Artificial Sequence
  Synthetic oligonucleotide
aacauguucaucgugucaa

SEQ ID NO: 17094 - RNA, 19 nt, Artificial Sequence
  Synthetic oligonucleotide
acauguucaucgugucaag

SEQ ID NO: 17095 - RNA, 19 nt, Artificial Sequence
  Synthetic oligonucleotide
cauguucaucgugucaagc

SEQ ID NO: 17096 - RNA, 19 nt, Artificial Sequence
  Synthetic oligonucleotide
uguucaucgugucaagcau

SEQ ID NO: 17097 - RNA, 19 nt, Artificial Sequence
  Synthetic oligonucleotide
guucaucgugucaagcauu

SEQ ID NO: 17098 - RNA, 19 nt, Artificial Sequence
  Synthetic oligonucleotide
uucaucgugucaagcauuu

SEQ ID NO: 17099 - RNA, 19 nt, Artificial Sequence
  Synthetic oligonucleotide
ucaucgugucaagcauuuu

SEQ ID NO: 17100 - RNA, 19 nt, Artificial Sequence
  Synthetic oligonucleotide
aucgugucaagcauuuuua

SEQ ID NO: 17101 - RNA, 19 nt, Artificial Sequence
  Synthetic oligonucleotide
ucgugucaagcauuuuuag

SEQ ID NO: 17102 - RNA, 19 nt, Artificial Sequence
  Synthetic oligonucleotide
cgugucaagcauuuuuagc

SEQ ID NO: 17103 - RNA, 19 nt, Artificial Sequence
  Synthetic oligonucleotide
ugucaagcauuuuuagcua

SEQ ID NO: 17104 - RNA, 19 nt, Artificial Sequence
  Synthetic oligonucleotide
gucaagcauuuuuagcuaa

SEQ ID NO: 17105 - RNA, 19 nt, Artificial Sequence
  Synthetic oligonucleotide
ucaagcauuuuuagcuaau

SEQ ID NO: 17106 - RNA, 19 nt, Artificial Sequence
  Synthetic oligonucleotide
caagcauuuuuagcuaauu

SEQ ID NO: 17107 - RNA, 19 nt, Artificial Sequence
  Synthetic oligonucleotide
agcauuuuuagcuaauuua

SEQ ID NO: 17108 - RNA, 19 nt, Artificial Sequence
  Synthetic oligonucleotide
gcauuuuuagcuaauuuag

SEQ ID NO: 17109 - RNA, 19 nt, Artificial Sequence
  Synthetic oligonucleotide
cauuuuuagcuaauuuaga

SEQ ID NO: 17110 - RNA, 19 nt, Artificial Sequence
  Synthetic oligonucleotide
auuuuuagcuaauuuagau

SEQ ID NO: 17111 - RNA, 19 nt, Artificial Sequence
  Synthetic oligonucleotide
uuuuuagcuaauuuagaug

SEQ ID NO: 17112 - RNA, 19 nt, Artificial Sequence
  Synthetic oligonucleotide
uuuuagcuaauuuagauga

SEQ ID NO: 17113 - RNA, 19 nt, Artificial Sequence
  Synthetic oligonucleotide
uuuagcuaauuuagaugaa

SEQ ID NO: 17114 - RNA, 19 nt, Artificial Sequence
  Synthetic oligonucleotide
uuagcuaauuuagaugaau

SEQ ID NO: 17115 - RNA, 19 nt, Artificial Sequence
  Synthetic oligonucleotide
uagcuaauuuagaugaauu

SEQ ID NO: 17116 - RNA, 19 nt, Artificial Sequence
  Synthetic oligonucleotide
agcuaauuuagaugaauuu

SEQ ID NO: 17117 - RNA, 19 nt, Artificial Sequence
  Synthetic oligonucleotide
gcuaauuuagaugaauuug

SEQ ID NO: 17118 - RNA, 19 nt, Artificial Sequence
  Synthetic oligonucleotide
cuaauuuagaugaauuugc

SEQ ID NO: 17119 - RNA, 19 nt, Artificial Sequence
  Synthetic oligonucleotide
aucuuuuuaaauggaugcu

SEQ ID NO: 17120 - RNA, 19 nt, Artificial Sequence
  Synthetic oligonucleotide
ucuuuuuaaauggaugcua

SEQ ID NO: 17121 - RNA, 19 nt, Artificial Sequence
  Synthetic oligonucleotide
cuuuuuaaauggaugcuaa

SEQ ID NO: 17122 - RNA, 19 nt, Artificial Sequence
  Synthetic oligonucleotide
uuuuuaaauggaugcuaaa

SEQ ID NO: 17123 - RNA, 19 nt, Artificial Sequence
  Synthetic oligonucleotide
uuuuaaauggaugcuaaaa

SEQ ID NO: 17124 - RNA, 19 nt, Artificial Sequence
  Synthetic oligonucleotide
uuuaaauggaugcuaaaau

SEQ ID NO: 17125 - RNA, 19 nt, Artificial Sequence
  Synthetic oligonucleotide
uuaaauggaugcuaaaauu

SEQ ID NO: 17126 - RNA, 19 nt, Artificial Sequence
  Synthetic oligonucleotide
uaaauggaugcuaaaauuc

SEQ ID NO: 17127 - RNA, 19 nt, Artificial Sequence
  Synthetic oligonucleotide
aaauggaugcuaaaauucc

SEQ ID NO: 17128 - RNA, 19 nt, Artificial Sequence
  Synthetic oligonucleotide
aauggaugcuaaaauuccu

SEQ ID NO: 17129 - RNA, 19 nt, Artificial Sequence
  Synthetic oligonucleotide
auggaugcuaaaauuccug

SEQ ID NO: 17130 - RNA, 19 nt, Artificial Sequence
  Synthetic oligonucleotide
ggaugcuaaaauuccugaa

SEQ ID NO: 17131 - RNA, 19 nt, Artificial Sequence
  Synthetic oligonucleotide
gaugcuaaaauuccugaag

SEQ ID NO: 17132 - RNA, 19 nt, Artificial Sequence
  Synthetic oligonucleotide
augcuaaaauuccugaagu

SEQ ID NO: 17133 - RNA, 19 nt, Artificial Sequence
  Synthetic oligonucleotide
ugcuaaaauuccugaaguu

SEQ ID NO: 17134 - RNA, 19 nt, Artificial Sequence
  Synthetic oligonucleotide
gcuaaaauuccugaaguuc

SEQ ID NO: 17135 - RNA, 19 nt, Artificial Sequence
  Synthetic oligonucleotide
cuaaaauuccugaaguuca

SEQ ID NO: 17136 - RNA, 19 nt, Artificial Sequence
  Synthetic oligonucleotide
uaaaauuccugaaguucag

SEQ ID NO: 17137 - RNA, 19 nt, Artificial Sequence
  Synthetic oligonucleotide
aaaauuccugaaguucagc

SEQ ID NO: 17138 - RNA, 19 nt, Artificial Sequence
  Synthetic oligonucleotide
aaauuccugaaguucagcu

SEQ ID NO: 17139 - RNA, 19 nt, Artificial Sequence
  Synthetic oligonucleotide
aauuccugaaguucagcug

SEQ ID NO: 17140 - RNA, 19 nt, Artificial Sequence
  Synthetic oligonucleotide
auuccugaaguucagcugc

SEQ ID NO: 17141 - RNA, 19 nt, Artificial Sequence
  Synthetic oligonucleotide
uuccugaaguucagcugca

SEQ ID NO: 17142 - RNA, 19 nt, Artificial Sequence
  Synthetic oligonucleotide
uccugaaguucagcugcau

SEQ ID NO: 17143 - RNA, 19 nt, Artificial Sequence
  Synthetic oligonucleotide
ccugaaguucagcugcaua

SEQ ID NO: 17144 - RNA, 19 nt, Artificial Sequence
  Synthetic oligonucleotide
cugaaguucagcugcauac

SEQ ID NO: 17145 - RNA, 19 nt, Artificial Sequence
  Synthetic oligonucleotide
ugaaguucagcugcauaca

SEQ ID NO: 17146 - RNA, 19 nt, Artificial Sequence
  Synthetic oligonucleotide
gaaguucagcugcauacag

SEQ ID NO: 17147 - RNA, 19 nt, Artificial Sequence
  Synthetic oligonucleotide
aaguucagcugcauacagu

SEQ ID NO: 17148 - RNA, 19 nt, Artificial Sequence
  Synthetic oligonucleotide
aguucagcugcauacaguu

SEQ ID NO: 17149 - RNA, 19 nt, Artificial Sequence
  Synthetic oligonucleotide
guucagcugcauacaguuu

SEQ ID NO: 17150 - RNA, 19 nt, Artificial Sequence
  Synthetic oligonucleotide
uucagcugcauacaguuug

SEQ ID NO: 17151 - RNA, 19 nt, Artificial Sequence
  Synthetic oligonucleotide
ucagcugcauacaguuugc

SEQ ID NO: 17152 - RNA, 19 nt, Artificial Sequence
  Synthetic oligonucleotide
cagcugcauacaguuugca

SEQ ID NO: 17153 - RNA, 19 nt, Artificial Sequence
  Synthetic oligonucleotide
agcugcauacaguuugcac

SEQ ID NO: 17154 - RNA, 19 nt, Artificial Sequence
  Synthetic oligonucleotide
gcugcauacaguuugcacu

SEQ ID NO: 17155 - RNA, 19 nt, Artificial Sequence
  Synthetic oligonucleotide
cugcauacaguuugcacuu

SEQ ID NO: 17156 - RNA, 19 nt, Artificial Sequence
  Synthetic oligonucleotide
ugcauacaguuugcacuua

SEQ ID NO: 17157 - RNA, 19 nt, Artificial Sequence
  Synthetic oligonucleotide
gcauacaguuugcacuuau

SEQ ID NO: 17158 - RNA, 19 nt, Artificial Sequence
  Synthetic oligonucleotide
cauacaguuugcacuuaug

SEQ ID NO: 17159 - RNA, 19 nt, Artificial Sequence
  Synthetic oligonucleotide
auacaguuugcacuuaugg

SEQ ID NO: 17160 - RNA, 19 nt, Artificial Sequence
  Synthetic oligonucleotide
uacaguuugcacuuaugga

SEQ ID NO: 17161 - RNA, 19 nt, Artificial Sequence
  Synthetic oligonucleotide
acaguuugcacuuauggac

SEQ ID NO: 17162 - RNA, 19 nt, Artificial Sequence
  Synthetic oligonucleotide
caguuugcacuuauggacu

SEQ ID NO: 17163 - RNA, 19 nt, Artificial Sequence
  Synthetic oligonucleotide
aguuugcacuuauggacuc

SEQ ID NO: 17164 - RNA, 19 nt, Artificial Sequence
  Synthetic oligonucleotide
guuugcacuuauggacucc

SEQ ID NO: 17165 - RNA, 19 nt, Artificial Sequence
  Synthetic oligonucleotide
uuugcacuuauggacuccu

SEQ ID NO: 17166 - RNA, 19 nt, Artificial Sequence
  Synthetic oligonucleotide
uugcacuuauggacuccug

SEQ ID NO: 17167 - RNA, 19 nt, Artificial Sequence
  Synthetic oligonucleotide
ugcacuuauggacuccugu

SEQ ID NO: 17168 - RNA, 19 nt, Artificial Sequence
  Synthetic oligonucleotide
gcacuuauggacuccuguu

SEQ ID NO: 17169 - RNA, 19 nt, Artificial Sequence
  Synthetic oligonucleotide
cacuuauggacuccuguug

SEQ ID NO: 17170 - RNA, 19 nt, Artificial Sequence
  Synthetic oligonucleotide
acuuauggacuccuguugu

SEQ ID NO: 17171 - RNA, 19 nt, Artificial Sequence
  Synthetic oligonucleotide
cuuauggacuccuguuguu

SEQ ID NO: 17172 - RNA, 19 nt, Artificial Sequence
  Synthetic oligonucleotide
uuauggacuccuguuguug

SEQ ID NO: 17173 - RNA, 19 nt, Artificial Sequence
  Synthetic oligonucleotide
uauggacuccuguuguuga

SEQ ID NO: 17174 - RNA, 19 nt, Artificial Sequence
  Synthetic oligonucleotide
uggacuccuguuguugaag

SEQ ID NO: 17175 - RNA, 19 nt, Artificial Sequence
  Synthetic oligonucleotide
agcuggucuuauuuguaaa

SEQ ID NO: 17176 - RNA, 19 nt, Artificial Sequence
  Synthetic oligonucleotide
gcuggucuuauuuguaaag

SEQ ID NO: 17177 - RNA, 19 nt, Artificial Sequence
  Synthetic oligonucleotide
cuggucuuauuuguaaagc

SEQ ID NO: 17178 - RNA, 19 nt, Artificial Sequence
  Synthetic oligonucleotide
uggucuuauuuguaaagcu

SEQ ID NO: 17179 - RNA, 19 nt, Artificial Sequence
  Synthetic oligonucleotide
ggucuuauuuguaaagcuc

SEQ ID NO: 17180 - RNA, 19 nt, Artificial Sequence
  Synthetic oligonucleotide
gucuuauuuguaaagcuca

SEQ ID NO: 17181 - RNA, 19 nt, Artificial Sequence
  Synthetic oligonucleotide
ucuuauuuguaaagcucac

SEQ ID NO: 17182 - RNA, 19 nt, Artificial Sequence
  Synthetic oligonucleotide
cuuauuuguaaagcucacu

SEQ ID NO: 17183 - RNA, 19 nt, Artificial Sequence
  Synthetic oligonucleotide
uuauuuguaaagcucacuu

SEQ ID NO: 17184 - RNA, 19 nt, Artificial Sequence
  Synthetic oligonucleotide
uauuuguaaagcucacuuu

SEQ ID NO: 17185 - RNA, 19 nt, Artificial Sequence
  Synthetic oligonucleotide
auuuguaaagcucacuuua

SEQ ID NO: 17186 - RNA, 19 nt, Artificial Sequence
  Synthetic oligonucleotide
uuuguaaagcucacuuuac

SEQ ID NO: 17187 - RNA, 19 nt, Artificial Sequence
  Synthetic oligonucleotide
uuguaaagcucacuuuacu

SEQ ID NO: 17188 - RNA, 19 nt, Artificial Sequence
  Synthetic oligonucleotide
uguaaagcucacuuuacuu

SEQ ID NO: 17189 - RNA, 19 nt, Artificial Sequence
  Synthetic oligonucleotide
guaaagcucacuuuacuua

SEQ ID NO: 17190 - RNA, 19 nt, Artificial Sequence
  Synthetic oligonucleotide
uaaagcucacuuuacuuag

SEQ ID NO: 17191 - RNA, 19 nt, Artificial Sequence
  Synthetic oligonucleotide
aaagcucacuuuacuuaga

SEQ ID NO: 17192 - RNA, 19 nt, Artificial Sequence
  Synthetic oligonucleotide
aagcucacuuuacuuagaa

SEQ ID NO: 17193 - RNA, 19 nt, Artificial Sequence
  Synthetic oligonucleotide
agcucacuuuacuuagaau

SEQ ID NO: 17194 - RNA, 19 nt, Artificial Sequence
  Synthetic oligonucleotide
gcucacuuuacuuagaauu

SEQ ID NO: 17195 - RNA, 19 nt, Artificial Sequence
  Synthetic oligonucleotide
cucacuuuacuuagaauua

SEQ ID NO: 17196 - RNA, 19 nt, Artificial Sequence
  Synthetic oligonucleotide
ucacuuuacuuagaauuag

SEQ ID NO: 17197 - RNA, 19 nt, Artificial Sequence
  Synthetic oligonucleotide
cacuuuacuuagaauuagu

SEQ ID NO: 17198 - RNA, 19 nt, Artificial Sequence
  Synthetic oligonucleotide
acuuuacuuagaauuagug

SEQ ID NO: 17199 - RNA, 19 nt, Artificial Sequence
  Synthetic oligonucleotide
cuuuacuuagaauuagugg

SEQ ID NO: 17200 - RNA, 19 nt, Artificial Sequence
  Synthetic oligonucleotide
uuuacuuagaauuaguggc

SEQ ID NO: 17201 - RNA, 19 nt, Artificial Sequence
  Synthetic oligonucleotide
uuacuuagaauuaguggca

SEQ ID NO: 17202 - RNA, 19 nt, Artificial Sequence
  Synthetic oligonucleotide
uacuuagaauuaguggcac

SEQ ID NO: 17203 - RNA, 19 nt, Artificial Sequence
  Synthetic oligonucleotide
acuuagaauuaguggcacu

SEQ ID NO: 17204 - RNA, 19 nt, Artificial Sequence
  Synthetic oligonucleotide
cuuagaauuaguggcacuu

SEQ ID NO: 17205 - RNA, 19 nt, Artificial Sequence
  Synthetic oligonucleotide
uuagaauuaguggcacuug

SEQ ID NO: 17206 - RNA, 19 nt, Artificial Sequence
  Synthetic oligonucleotide
uagaauuaguggcacuugc

SEQ ID NO: 17207 - RNA, 19 nt, Artificial Sequence
  Synthetic oligonucleotide
agaauuaguggcacuugcu

SEQ ID NO: 17208 - RNA, 19 nt, Artificial Sequence
  Synthetic oligonucleotide
gaauuaguggcacuugcuu

SEQ ID NO: 17209 - RNA, 19 nt, Artificial Sequence
  Synthetic oligonucleotide
aauuaguggcacuugcuuu

SEQ ID NO: 17210 - RNA, 19 nt, Artificial Sequence
  Synthetic oligonucleotide
auuaguggcacuugcuuuu

SEQ ID NO: 17211 - RNA, 19 nt, Artificial Sequence
  Synthetic oligonucleotide
uuaguggcacuugcuuuua

SEQ ID NO: 17212 - RNA, 19 nt, Artificial Sequence
  Synthetic oligonucleotide
uaguggcacuugcuuuuau

SEQ ID NO: 17213 - RNA, 19 nt, Artificial Sequence
  Synthetic oligonucleotide
aguggcacuugcuuuuauu

SEQ ID NO: 17214 - RNA, 19 nt, Artificial Sequence
  Synthetic oligonucleotide
guggcacuugcuuuuauua

SEQ ID NO: 17215 - RNA, 19 nt, Artificial Sequence
  Synthetic oligonucleotide
uggcacuugcuuuuauuag

SEQ ID NO: 17216 - RNA, 19 nt, Artificial Sequence
  Synthetic oligonucleotide
ggcacuugcuuuuauuaga

SEQ ID NO: 17217 - RNA, 19 nt, Artificial Sequence
  Synthetic oligonucleotide
gcacuugcuuuuauuagag

SEQ ID NO: 17218 - RNA, 19 nt, Artificial Sequence
  Synthetic oligonucleotide
cacuugcuuuuauuagaga

SEQ ID NO: 17219 - RNA, 19 nt, Artificial Sequence
  Synthetic oligonucleotide
acuugcuuuuauuagagaa

SEQ ID NO: 17220 - RNA, 19 nt, Artificial Sequence
  Synthetic oligonucleotide
cuugcuuuuauuagagaau

SEQ ID NO: 17221 - RNA, 19 nt, Artificial Sequence
  Synthetic oligonucleotide
uuuuauuagagaaugauuu

SEQ ID NO: 17222 - RNA, 19 nt, Artificial Sequence
  Synthetic oligonucleotide
gcuguaacuuucugaaaua

SEQ ID NO: 17223 - RNA, 19 nt, Artificial Sequence
  Synthetic oligonucleotide
cuguaacuuucugaaauaa

SEQ ID NO: 17224 - RNA, 19 nt, Artificial Sequence
  Synthetic oligonucleotide
uguaacuuucugaaauaac

SEQ ID NO: 17225 - RNA, 19 nt, Artificial Sequence
  Synthetic oligonucleotide
guaacuuucugaaauaaca

SEQ ID NO: 17226 - RNA, 19 nt, Artificial Sequence
  Synthetic oligonucleotide
uaacuuucugaaauaacau

SEQ ID NO: 17227 - RNA, 19 nt, Artificial Sequence
  Synthetic oligonucleotide
aacuuucugaaauaacaug

SEQ ID NO: 17228 - RNA, 19 nt, Artificial Sequence
  Synthetic oligonucleotide
acuuucugaaauaacaugg

SEQ ID NO: 17229 - RNA, 19 nt, Artificial Sequence
  Synthetic oligonucleotide
cuuucugaaauaacauggc

SEQ ID NO: 17230 - RNA, 19 nt, Artificial Sequence
  Synthetic oligonucleotide
uuucugaaauaacauggcc

SEQ ID NO: 17231 - RNA, 19 nt, Artificial Sequence
  Synthetic oligonucleotide
uucugaaauaacauggccu

SEQ ID NO: 17232 - RNA, 19 nt, Artificial Sequence
  Synthetic oligonucleotide
ucugaaauaacauggccuu

SEQ ID NO: 17233 - RNA, 19 nt, Artificial Sequence
  Synthetic oligonucleotide
cugaaauaacauggccuug

SEQ ID NO: 17234 - RNA, 19 nt, Artificial Sequence
  Synthetic oligonucleotide
ugaaauaacauggccuugg

SEQ ID NO: 17235 - RNA, 19 nt, Artificial Sequence
  Synthetic oligonucleotide
gaaauaacauggccuugga

SEQ ID NO: 17236 - RNA, 19 nt, Artificial Sequence
  Synthetic oligonucleotide
aaauaacauggccuuggag

SEQ ID NO: 17237 - RNA, 19 nt, Artificial Sequence
  Synthetic oligonucleotide
aauaacauggccuuggagg

SEQ ID NO: 17238 - RNA, 19 nt, Artificial Sequence
  Synthetic oligonucleotide
auaacauggccuuggaggg

SEQ ID NO: 17239 - RNA, 19 nt, Artificial Sequence
  Synthetic oligonucleotide
uaacauggccuuggagggc

SEQ ID NO: 17240 - RNA, 19 nt, Artificial Sequence
  Synthetic oligonucleotide
aacauggccuuggagggca

SEQ ID NO: 17241 - RNA, 19 nt, Artificial Sequence
  Synthetic oligonucleotide
acauggccuuggagggcau

SEQ ID NO: 17242 - RNA, 19 nt, Artificial Sequence
  Synthetic oligonucleotide
cauggccuuggagggcaug

SEQ ID NO: 17243 - RNA, 19 nt, Artificial Sequence
  Synthetic oligonucleotide
auggccuuggagggcauga

SEQ ID NO: 17244 - RNA, 19 nt, Artificial Sequence
  Synthetic oligonucleotide
uggccuuggagggcaugaa

SEQ ID NO: 17245 - RNA, 19 nt, Artificial Sequence
  Synthetic oligonucleotide
ggccuuggagggcaugaag

SEQ ID NO: 17246 - RNA, 19 nt, Artificial Sequence
  Synthetic oligonucleotide
gccuuggagggcaugaaga

SEQ ID NO: 17247 - RNA, 19 nt, Artificial Sequence
  Synthetic oligonucleotide
ccuuggagggcaugaagac

SEQ ID NO: 17248 - RNA, 19 nt, Artificial Sequence
  Synthetic oligonucleotide
cuuggagggcaugaagaca

SEQ ID NO: 17249 - RNA, 19 nt, Artificial Sequence
  Synthetic oligonucleotide
uuggagggcaugaagacag

SEQ ID NO: 17250 - RNA, 19 nt, Artificial Sequence
  Synthetic oligonucleotide
uggagggcaugaagacaga

SEQ ID NO: 17251 - RNA, 19 nt, Artificial Sequence
  Synthetic oligonucleotide
ggagggcaugaagacagau

SEQ ID NO: 17252 - RNA, 19 nt, Artificial Sequence
  Synthetic oligonucleotide
gagggcaugaagacagaua

SEQ ID NO: 17253 - RNA, 19 nt, Artificial Sequence
  Synthetic oligonucleotide
agggcaugaagacagauac

SEQ ID NO: 17254 - RNA, 19 nt, Artificial Sequence
  Synthetic oligonucleotide
gggcaugaagacagauacu

SEQ ID NO: 17255 - RNA, 19 nt, Artificial Sequence
  Synthetic oligonucleotide
ggcaugaagacagauacuc

SEQ ID NO: 17256 - RNA, 19 nt, Artificial Sequence
  Synthetic oligonucleotide
gcaugaagacagauacucc

SEQ ID NO: 17257 - RNA, 19 nt, Artificial Sequence
  Synthetic oligonucleotide
caugaagacagauacuccu

SEQ ID NO: 17258 - RNA, 19 nt, Artificial Sequence
  Synthetic oligonucleotide
augaagacagauacuccuc

SEQ ID NO: 17259 - RNA, 19 nt, Artificial Sequence
  Synthetic oligonucleotide
ugaagacagauacuccucc

SEQ ID NO: 17260 - RNA, 19 nt, Artificial Sequence
  Synthetic oligonucleotide
gaagacagauacuccucca

SEQ ID NO: 17261 - RNA, 19 nt, Artificial Sequence
  Synthetic oligonucleotide
aagacagauacuccuccaa

SEQ ID NO: 17262 - RNA, 19 nt, Artificial Sequence
  Synthetic oligonucleotide
agacagauacuccuccaag

SEQ ID NO: 17263 - RNA, 19 nt, Artificial Sequence
  Synthetic oligonucleotide
gacagauacuccuccaagg

SEQ ID NO: 17264 - RNA, 19 nt, Artificial Sequence
  Synthetic oligonucleotide
acagauacuccuccaaggu

SEQ ID NO: 17265 - RNA, 19 nt, Artificial Sequence
  Synthetic oligonucleotide
agauacuccuccaagguua

SEQ ID NO: 17266 - RNA, 19 nt, Artificial Sequence
  Synthetic oligonucleotide
gauacuccuccaagguuau

SEQ ID NO: 17267 - RNA, 19 nt, Artificial Sequence
  Synthetic oligonucleotide
auacuccuccaagguuauu

SEQ ID NO: 17268 - RNA, 19 nt, Artificial Sequence
  Synthetic oligonucleotide
uacuccuccaagguuauug

SEQ ID NO: 17269 - RNA, 19 nt, Artificial Sequence
  Synthetic oligonucleotide
acuccuccaagguuauugg

SEQ ID NO: 17270 - RNA, 19 nt, Artificial Sequence
  Synthetic oligonucleotide
cuccuccaagguuauugga

SEQ ID NO: 17271 - RNA, 19 nt, Artificial Sequence
  Synthetic oligonucleotide
uccuccaagguuauuggac

SEQ ID NO: 17272 - RNA, 19 nt, Artificial Sequence
  Synthetic oligonucleotide
ccuccaagguuauuggaca

SEQ ID NO: 17273 - RNA, 19 nt, Artificial Sequence
  Synthetic oligonucleotide
cuccaagguuauuggacac

SEQ ID NO: 17274 - RNA, 19 nt, Artificial Sequence
  Synthetic oligonucleotide
uccaagguuauuggacacc

SEQ ID NO: 17275 - RNA, 19 nt, Artificial Sequence
  Synthetic oligonucleotide
ccaagguuauuggacaccg

SEQ ID NO: 17276 - RNA, 19 nt, Artificial Sequence
  Synthetic oligonucleotide
caagguuauuggacaccgg

SEQ ID NO: 17277 - RNA, 19 nt, Artificial Sequence
  Synthetic oligonucleotide
aagguuauuggacaccgga

SEQ ID NO: 17278 - RNA, 19 nt, Artificial Sequence
  Synthetic oligonucleotide
agguuauuggacaccggaa

SEQ ID NO: 17279 - RNA, 19 nt, Artificial Sequence
  Synthetic oligonucleotide
gguuauuggacaccggaaa

SEQ ID NO: 17280 - RNA, 19 nt, Artificial Sequence
  Synthetic oligonucleotide
guuauuggacaccggaaac

SEQ ID NO: 17281 - RNA, 19 nt, Artificial Sequence
  Synthetic oligonucleotide
uuauuggacaccggaaaca

SEQ ID NO: 17282 - RNA, 19 nt, Artificial Sequence
  Synthetic oligonucleotide
uauuggacaccggaaacaa

SEQ ID NO: 17283 - RNA, 19 nt, Artificial Sequence
  Synthetic oligonucleotide
auuggacaccggaaacaau

SEQ ID NO: 17284 - RNA, 19 nt, Artificial Sequence
  Synthetic oligonucleotide
uuggacaccggaaacaaua

SEQ ID NO: 17285 - RNA, 19 nt, Artificial Sequence
  Synthetic oligonucleotide
uggacaccggaaacaauaa

SEQ ID NO: 17286 - RNA, 19 nt, Artificial Sequence
  Synthetic oligonucleotide
ggacaccggaaacaauaaa

SEQ ID NO: 17287 - RNA, 19 nt, Artificial Sequence
  Synthetic oligonucleotide
gacaccggaaacaauaaau

SEQ ID NO: 17288 - RNA, 19 nt, Artificial Sequence
  Synthetic oligonucleotide
acaccggaaacaauaaauu

SEQ ID NO: 17289 - RNA, 19 nt, Artificial Sequence
  Synthetic oligonucleotide
gaacaccuccucaaaccua

SEQ ID NO: 17290 - RNA, 19 nt, Artificial Sequence
  Synthetic oligonucleotide
aacaccuccucaaaccuac

SEQ ID NO: 17291 - RNA, 19 nt, Artificial Sequence
  Synthetic oligonucleotide
acaccuccucaaaccuacc

SEQ ID NO: 17292 - RNA, 19 nt, Artificial Sequence
  Synthetic oligonucleotide
caccuccucaaaccuacca

SEQ ID NO: 17293 - RNA, 19 nt, Artificial Sequence
  Synthetic oligonucleotide
accuccucaaaccuaccac

SEQ ID NO: 17294 - RNA, 19 nt, Artificial Sequence
  Synthetic oligonucleotide
ccuccucaaaccuaccacu

SEQ ID NO: 17295 - RNA, 19 nt, Artificial Sequence
  Synthetic oligonucleotide
gccgaaagaacaguccauu

SEQ ID NO: 17296 - RNA, 19 nt, Artificial Sequence
  Synthetic oligonucleotide
ccgaaagaacaguccauug

SEQ ID NO: 17297 - RNA, 19 nt, Artificial Sequence
  Synthetic oligonucleotide
cgaaagaacaguccauuga

SEQ ID NO: 17298 - RNA, 19 nt, Artificial Sequence
  Synthetic oligonucleotide
gaaagaacaguccauugaa

SEQ ID NO: 17299 - RNA, 19 nt, Artificial Sequence
  Synthetic oligonucleotide
aaagaacaguccauugaaa

SEQ ID NO: 17300 - RNA, 19 nt, Artificial Sequence
  Synthetic oligonucleotide
ggaguauuacaaaaacaug

SEQ ID NO: 17301 - RNA, 19 nt, Artificial Sequence
  Synthetic oligonucleotide
gaguauuacaaaaacaugg

SEQ ID NO: 17302 - RNA, 19 nt, Artificial Sequence
  Synthetic oligonucleotide
aguauuacaaaaacauggc

SEQ ID NO: 17303 - RNA, 19 nt, Artificial Sequence
  Synthetic oligonucleotide
guauuacaaaaacauggcc

SEQ ID NO: 17304 - RNA, 19 nt, Artificial Sequence
  Synthetic oligonucleotide
uauuacaaaaacauggccu

SEQ ID NO: 17305 - RNA, 19 nt, Artificial Sequence
  Synthetic oligonucleotide
auuacaaaaacauggccuu

SEQ ID NO: 17306 - RNA, 19 nt, Artificial Sequence
  Synthetic oligonucleotide
uuacaaaaacauggccuuu

SEQ ID NO: 17307 - RNA, 19 nt, Artificial Sequence
  Synthetic oligonucleotide
uacaaaaacauggccuuug

SEQ ID NO: 17308 - RNA, 19 nt, Artificial Sequence
  Synthetic oligonucleotide
acaaaaacauggccuuugc

SEQ ID NO: 17309 - RNA, 19 nt, Artificial Sequence
  Synthetic oligonucleotide
caaaaacauggccuuugcu

SEQ ID NO: 17310 - RNA, 19 nt, Artificial Sequence
  Synthetic oligonucleotide
aaaaacauggccuuugcuu

SEQ ID NO: 17311 - RNA, 19 nt, Artificial Sequence
  Synthetic oligonucleotide
aaaacauggccuuugcuug

SEQ ID NO: 17312 - RNA, 19 nt, Artificial Sequence
  Synthetic oligonucleotide
aaacauggccuuugcuuga

SEQ ID NO: 17313 - RNA, 19 nt, Artificial Sequence
  Synthetic oligonucleotide
aacauggccuuugcuugaa

SEQ ID NO: 17314 - RNA, 19 nt, Artificial Sequence
  Synthetic oligonucleotide
acauggccuuugcuugaaa

SEQ ID NO: 17315 - RNA, 19 nt, Artificial Sequence
  Synthetic oligonucleotide
cauggccuuugcuugaaag

SEQ ID NO: 17316 - RNA, 19 nt, Artificial Sequence
  Synthetic oligonucleotide
auggccuuugcuugaaaga

SEQ ID NO: 17317 - RNA, 19 nt, Artificial Sequence
  Synthetic oligonucleotide
uggccuuugcuugaaagaa

SEQ ID NO: 17318 - RNA, 19 nt, Artificial Sequence
  Synthetic oligonucleotide
ggccuuugcuugaaagaaa

SEQ ID NO: 17319 - RNA, 19 nt, Artificial Sequence
  Synthetic oligonucleotide
gccuuugcuugaaagaaaa

SEQ ID NO: 17320 - RNA, 19 nt, Artificial Sequence
  Synthetic oligonucleotide
ccuuugcuugaaagaaaau

SEQ ID NO: 17321 - RNA, 19 nt, Artificial Sequence
  Synthetic oligonucleotide
cuuugcuugaaagaaaaua

SEQ ID NO: 17322 - RNA, 19 nt, Artificial Sequence
  Synthetic oligonucleotide
uuugcuugaaagaaaauac

SEQ ID NO: 17323 - RNA, 19 nt, Artificial Sequence
  Synthetic oligonucleotide
uugcuugaaagaaaauacc

SEQ ID NO: 17324 - RNA, 19 nt, Artificial Sequence
  Synthetic oligonucleotide
ugcuugaaagaaaauacca

SEQ ID NO: 17325 - RNA, 19 nt, Artificial Sequence
  Synthetic oligonucleotide
acaggaaacugaucauuaa

SEQ ID NO: 17326 - RNA, 19 nt, Artificial Sequence
  Synthetic oligonucleotide
caggaaacugaucauuaaa

SEQ ID NO: 17327 - RNA, 19 nt, Artificial Sequence
  Synthetic oligonucleotide
aggaaacugaucauuaaag

SEQ ID NO: 17328 - RNA, 19 nt, Artificial Sequence
  Synthetic oligonucleotide
ggaaacugaucauuaaagc

SEQ ID NO: 17329 - RNA, 19 nt, Artificial Sequence
  Synthetic oligonucleotide
gaaacugaucauuaaagcc

SEQ ID NO: 17330 - RNA, 19 nt, Artificial Sequence
  Synthetic oligonucleotide
aaacugaucauuaaagccu

SEQ ID NO: 17331 - RNA, 19 nt, Artificial Sequence
  Synthetic oligonucleotide
aacugaucauuaaagccug

SEQ ID NO: 17332 - RNA, 19 nt, Artificial Sequence
  Synthetic oligonucleotide
acugaucauuaaagccuga

SEQ ID NO: 17333 - RNA, 19 nt, Artificial Sequence
  Synthetic oligonucleotide
cugaucauuaaagccugag

SEQ ID NO: 17334 - RNA, 19 nt, Artificial Sequence
  Synthetic oligonucleotide
ugaucauuaaagccugagu

SEQ ID NO: 17335 - RNA, 19 nt, Artificial Sequence
  Synthetic oligonucleotide
gaucauuaaagccugaguu

SEQ ID NO: 17336 - RNA, 19 nt, Artificial Sequence
  Synthetic oligonucleotide
aucauuaaagccugaguuu

SEQ ID NO: 17337 - RNA, 19 nt, Artificial Sequence
  Synthetic oligonucleotide
ucauuaaagccugaguuug

SEQ ID NO: 17338 - RNA, 19 nt, Artificial Sequence
  Synthetic oligonucleotide
uuaaagccugaguuugcuu

SEQ ID NO: 17339 - RNA, 19 nt, Artificial Sequence
  Synthetic oligonucleotide
uaaagccugaguuugcuuu

SEQ ID NO: 17340 - RNA, 19 nt, Artificial Sequence
  Synthetic oligonucleotide
ccugcuaccuccaaccaug

SEQ ID NO: 17341 - RNA, 19 nt, Artificial Sequence
  Synthetic oligonucleotide
cugcuaccuccaaccaugg

SEQ ID NO: 17342 - RNA, 19 nt, Artificial Sequence
  Synthetic oligonucleotide
ugcuaccuccaaccauggg

SEQ ID NO: 17343 - RNA, 19 nt, Artificial Sequence
  Synthetic oligonucleotide
gcuaccuccaaccaugggc

SEQ ID NO: 17344 - RNA, 19 nt, Artificial Sequence
  Synthetic oligonucleotide
accuccaaccaugggccuu

SEQ ID NO: 17345 - RNA, 19 nt, Artificial Sequence
  Synthetic oligonucleotide
ccuccaaccaugggccuuu

SEQ ID NO: 17346 - RNA, 19 nt, Artificial Sequence
  Synthetic oligonucleotide
cuccaaccaugggccuuuu

SEQ ID NO: 17347 - RNA, 19 nt, Artificial Sequence
  Synthetic oligonucleotide
uccaaccaugggccuuuug

SEQ ID NO: 17348 - RNA, 19 nt, Artificial Sequence
  Synthetic oligonucleotide
ccaaccaugggccuuuugg

SEQ ID NO: 17349 - RNA, 19 nt, Artificial Sequence
  Synthetic oligonucleotide
caaccaugggccuuuuggg

SEQ ID NO: 17350 - RNA, 19 nt, Artificial Sequence
  Synthetic oligonucleotide
aaccaugggccuuuuggga

SEQ ID NO: 17351 - RNA, 19 nt, Artificial Sequence
  Synthetic oligonucleotide
accaugggccuuuugggaa

SEQ ID NO: 17352 - RNA, 19 nt, Artificial Sequence
  Synthetic oligonucleotide
ccaugggccuuuugggaau

SEQ ID NO: 17353 - RNA, 19 nt, Artificial Sequence
  Synthetic oligonucleotide
caugggccuuuugggaaua

SEQ ID NO: 17354 - RNA, 19 nt, Artificial Sequence
  Synthetic oligonucleotide
augggccuuuugggaauac

SEQ ID NO: 17355 - RNA, 19 nt, Artificial Sequence
  Synthetic oligonucleotide
ugggccuuuugggaauacu

SEQ ID NO: 17356 - RNA, 19 nt, Artificial Sequence
  Synthetic oligonucleotide
gggccuuuugggaauacuu

SEQ ID NO: 17357 - RNA, 19 nt, Artificial Sequence
  Synthetic oligonucleotide
ggccuuuugggaauacuuu

SEQ ID NO: 17358 - RNA, 19 nt, Artificial Sequence
  Synthetic oligonucleotide
gccuuuugggaauacuuug

SEQ ID NO: 17359 - RNA, 19 nt, Artificial Sequence
  Synthetic oligonucleotide
ccuuuugggaauacuuugu

SEQ ID NO: 17360 - RNA, 19 nt, Artificial Sequence
  Synthetic oligonucleotide
cuuuugggaauacuuuguu

SEQ ID NO: 17361 - RNA, 19 nt, Artificial Sequence
  Synthetic oligonucleotide
uuuugggaauacuuuguuu

SEQ ID NO: 17362 - RNA, 19 nt, Artificial Sequence
  Synthetic oligonucleotide
uuugggaauacuuuguuuu

SEQ ID NO: 17363 - RNA, 19 nt, Artificial Sequence
  Synthetic oligonucleotide
uugggaauacuuuguuuuu

SEQ ID NO: 17364 - RNA, 19 nt, Artificial Sequence
  Synthetic oligonucleotide
ugggaauacuuuguuuuuu

SEQ ID NO: 17365 - RNA, 19 nt, Artificial Sequence
  Synthetic oligonucleotide
gggaauacuuuguuuuuua

SEQ ID NO: 17366 - RNA, 19 nt, Artificial Sequence
  Synthetic oligonucleotide
ggaauacuuuguuuuuuaa

SEQ ID NO: 17367 - RNA, 19 nt, Artificial Sequence
  Synthetic oligonucleotide
gaauacuuuguuuuuuaau

SEQ ID NO: 17368 - RNA, 19 nt, Artificial Sequence
  Synthetic oligonucleotide
aauacuuuguuuuuuaauc

SEQ ID NO: 17369 - RNA, 19 nt, Artificial Sequence
  Synthetic oligonucleotide
auacuuuguuuuuuaaucu

SEQ ID NO: 17370 - RNA, 19 nt, Artificial Sequence
  Synthetic oligonucleotide
uacuuuguuuuuuaaucuu

SEQ ID NO: 17371 - RNA, 19 nt, Artificial Sequence
  Synthetic oligonucleotide
acuuuguuuuuuaaucuuc

SEQ ID NO: 17372 - RNA, 19 nt, Artificial Sequence
  Synthetic oligonucleotide
cuuuguuuuuuaaucuucc

SEQ ID NO: 17373 - RNA, 19 nt, Artificial Sequence
  Synthetic oligonucleotide
uuuguuuuuuaaucuuccu

SEQ ID NO: 17374 - RNA, 19 nt, Artificial Sequence
  Synthetic oligonucleotide
uuguuuuuuaaucuuccug

SEQ ID NO: 17375 - RNA, 19 nt, Artificial Sequence
  Synthetic oligonucleotide
uguuuuuuaaucuuccugg

SEQ ID NO: 17376 - RNA, 19 nt, Artificial Sequence
  Synthetic oligonucleotide
cuggggacaggagcaaaca

SEQ ID NO: 17377 - RNA, 19 nt, Artificial Sequence
  Synthetic oligonucleotide
uggggacaggagcaaacau

SEQ ID NO: 17378 - RNA, 19 nt, Artificial Sequence
  Synthetic oligonucleotide
ggggacaggagcaaacaua

SEQ ID NO: 17379 - RNA, 19 nt, Artificial Sequence
  Synthetic oligonucleotide
gggacaggagcaaacauau

SEQ ID NO: 17380 - RNA, 19 nt, Artificial Sequence
  Synthetic oligonucleotide
ggacaggagcaaacauaug

SEQ ID NO: 17381 - RNA, 19 nt, Artificial Sequence
  Synthetic oligonucleotide
gacaggagcaaacauaugu

SEQ ID NO: 17382 - RNA, 19 nt, Artificial Sequence
  Synthetic oligonucleotide
acaggagcaaacauauguc

SEQ ID NO: 17383 - RNA, 19 nt, Artificial Sequence
  Synthetic oligonucleotide
caggagcaaacauauguca

SEQ ID NO: 17384 - RNA, 19 nt, Artificial Sequence
  Synthetic oligonucleotide
aggagcaaacauaugucau

SEQ ID NO: 17385 - RNA, 19 nt, Artificial Sequence
  Synthetic oligonucleotide
ggagcaaacauaugucauu

SEQ ID NO: 17386 - RNA, 19 nt, Artificial Sequence
  Synthetic oligonucleotide
gagcaaacauaugucauuu

SEQ ID NO: 17387 - RNA, 19 nt, Artificial Sequence
  Synthetic oligonucleotide
agcaaacauaugucauuuc

SEQ ID NO: 17388 - RNA, 19 nt, Artificial Sequence
  Synthetic oligonucleotide
gcaaacauaugucauuuca

SEQ ID NO: 17389 - RNA, 19 nt, Artificial Sequence
  Synthetic oligonucleotide
caaacauaugucauuucag

SEQ ID NO: 17390 - RNA, 19 nt, Artificial Sequence
  Synthetic oligonucleotide
aaacauaugucauuucagc

SEQ ID NO: 17391 - RNA, 19 nt, Artificial Sequence
  Synthetic oligonucleotide
aacauaugucauuucagca

SEQ ID NO: 17392 - RNA, 19 nt, Artificial Sequence
  Synthetic oligonucleotide
acauaugucauuucagcac

SEQ ID NO: 17393 - RNA, 19 nt, Artificial Sequence
  Synthetic oligonucleotide
auaugucauuucagcacca

SEQ ID NO: 17394 - RNA, 19 nt, Artificial Sequence
  Synthetic oligonucleotide
uaugucauuucagcaccaa

SEQ ID NO: 17395 - RNA, 19 nt, Artificial Sequence
  Synthetic oligonucleotide
augucauuucagcaccaaa

SEQ ID NO: 17396 - RNA, 19 nt, Artificial Sequence
  Synthetic oligonucleotide
ugucauuucagcaccaaaa

SEQ ID NO: 17397 - RNA, 19 nt, Artificial Sequence
  Synthetic oligonucleotide
gucauuucagcaccaaaaa

SEQ ID NO: 17398 - RNA, 19 nt, Artificial Sequence
  Synthetic oligonucleotide
ucauuucagcaccaaaaau

SEQ ID NO: 17399 - RNA, 19 nt, Artificial Sequence
  Synthetic oligonucleotide
cauuucagcaccaaaaaua

SEQ ID NO: 17400 - RNA, 19 nt, Artificial Sequence
  Synthetic oligonucleotide
auuucagcaccaaaaauau

SEQ ID NO: 17401 - RNA, 19 nt, Artificial Sequence
  Synthetic oligonucleotide
uuucagcaccaaaaauauu

SEQ ID NO: 17402 - RNA, 19 nt, Artificial Sequence
  Synthetic oligonucleotide
uucagcaccaaaaauauuc

SEQ ID NO: 17403 - RNA, 19 nt, Artificial Sequence
  Synthetic oligonucleotide
ucagcaccaaaaauauucc

SEQ ID NO: 17404 - RNA, 19 nt, Artificial Sequence
  Synthetic oligonucleotide
cagcaccaaaaauauuccg

SEQ ID NO: 17405 - RNA, 19 nt, Artificial Sequence
  Synthetic oligonucleotide
agcaccaaaaauauuccgu

SEQ ID NO: 17406 - RNA, 19 nt, Artificial Sequence
  Synthetic oligonucleotide
gcaccaaaaauauuccgug

SEQ ID NO: 17407 - RNA, 19 nt, Artificial Sequence
  Synthetic oligonucleotide
caccaaaaauauuccgugu

SEQ ID NO: 17408 - RNA, 19 nt, Artificial Sequence
  Synthetic oligonucleotide
accaaaaauauuccguguu

SEQ ID NO: 17409 - RNA, 19 nt, Artificial Sequence
  Synthetic oligonucleotide
ccaaaaauauuccguguug

SEQ ID NO: 17410 - RNA, 19 nt, Artificial Sequence
  Synthetic oligonucleotide
caaaaauauuccguguugg

SEQ ID NO: 17411 - RNA, 19 nt, Artificial Sequence
  Synthetic oligonucleotide
aaaaauauuccguguugga

SEQ ID NO: 17412 - RNA, 19 nt, Artificial Sequence
  Synthetic oligonucleotide
aaaauauuccguguuggag

SEQ ID NO: 17413 - RNA, 19 nt, Artificial Sequence
  Synthetic oligonucleotide
aaauauuccguguuggagc

SEQ ID NO: 17414 - RNA, 19 nt, Artificial Sequence
  Synthetic oligonucleotide
aauauuccguguuggagca

SEQ ID NO: 17415 - RNA, 19 nt, Artificial Sequence
  Synthetic oligonucleotide
auauuccguguuggagcau

SEQ ID NO: 17416 - RNA, 19 nt, Artificial Sequence
  Synthetic oligonucleotide
uauuccguguuggagcauc

SEQ ID NO: 17417 - RNA, 19 nt, Artificial Sequence
  Synthetic oligonucleotide
auuccguguuggagcaucu

SEQ ID NO: 17418 - RNA, 19 nt, Artificial Sequence
  Synthetic oligonucleotide
uuccguguuggagcaucug

SEQ ID NO: 17419 - RNA, 19 nt, Artificial Sequence
  Synthetic oligonucleotide
uccguguuggagcaucuga

SEQ ID NO: 17420 - RNA, 19 nt, Artificial Sequence
  Synthetic oligonucleotide
ccguguuggagcaucugaa

SEQ ID NO: 17421 - RNA, 19 nt, Artificial Sequence
  Synthetic oligonucleotide
cguguuggagcaucugaaa

SEQ ID NO: 17422 - RNA, 19 nt, Artificial Sequence
  Synthetic oligonucleotide
aguuuauggauacacugaa

SEQ ID NO: 17423 - RNA, 19 nt, Artificial Sequence
  Synthetic oligonucleotide
uuauggauacacugaagca

SEQ ID NO: 17424 - RNA, 19 nt, Artificial Sequence
  Synthetic oligonucleotide
auggauacacugaagcauu

SEQ ID NO: 17425 - RNA, 19 nt, Artificial Sequence
  Synthetic oligonucleotide
cugaagcauuugaugcaac

SEQ ID NO: 17426 - RNA, 19 nt, Artificial Sequence
  Synthetic oligonucleotide
gaagcauuugaugcaacaa

SEQ ID NO: 17427 - RNA, 19 nt, Artificial Sequence
  Synthetic oligonucleotide
agcauuugaugcaacaauc

SEQ ID NO: 17428 - RNA, 19 nt, Artificial Sequence
  Synthetic oligonucleotide
cauuugaugcaacaaucuc

SEQ ID NO: 17429 - RNA, 19 nt, Artificial Sequence
  Synthetic oligonucleotide
auuugaugcaacaaucucu

SEQ ID NO: 17430 - RNA, 19 nt, Artificial Sequence
  Synthetic oligonucleotide
uuugaugcaacaaucucua

SEQ ID NO: 17431 - RNA, 19 nt, Artificial Sequence
  Synthetic oligonucleotide
ugcaacaaucucuauuaaa

SEQ ID NO: 17432 - RNA, 19 nt, Artificial Sequence
  Synthetic oligonucleotide
gcaacaaucucuauuaaaa

SEQ ID NO: 17433 - RNA, 19 nt, Artificial Sequence
  Synthetic oligonucleotide
caacaaucucuauuaaaag

SEQ ID NO: 17434 - RNA, 19 nt, Artificial Sequence
  Synthetic oligonucleotide
caaucucuauuaaaaguua

SEQ ID NO: 17435 - RNA, 19 nt, Artificial Sequence
  Synthetic oligonucleotide
aaucucuauuaaaaguuau

SEQ ID NO: 17436 - RNA, 19 nt, Artificial Sequence
  Synthetic oligonucleotide
aucucuauuaaaaguuauc

SEQ ID NO: 17437 - RNA, 19 nt, Artificial Sequence
  Synthetic oligonucleotide
ucucuauuaaaaguuaucc

SEQ ID NO: 17438 - RNA, 19 nt, Artificial Sequence
  Synthetic oligonucleotide
cucuauuaaaaguuauccu

SEQ ID NO: 17439 - RNA, 19 nt, Artificial Sequence
  Synthetic oligonucleotide
cuauuaaaaguuauccuga

SEQ ID NO: 17440 - RNA, 19 nt, Artificial Sequence
  Synthetic oligonucleotide
auuaaaaguuauccugaua

SEQ ID NO: 17441 - RNA, 19 nt, Artificial Sequence
  Synthetic oligonucleotide
uuaaaaguuauccugauaa

SEQ ID NO: 17442 - RNA, 19 nt, Artificial Sequence
  Synthetic oligonucleotide
aaaguuauccugauaaaaa

SEQ ID NO: 17443 - RNA, 19 nt, Artificial Sequence
  Synthetic oligonucleotide
aaguuauccugauaaaaaa

SEQ ID NO: 17444 - RNA, 19 nt, Artificial Sequence
  Synthetic oligonucleotide
uuauccugauaaaaaauuu

SEQ ID NO: 17445 - RNA, 19 nt, Artificial Sequence
  Synthetic oligonucleotide
uauccugauaaaaaauuua

SEQ ID NO: 17446 - RNA, 19 nt, Artificial Sequence
  Synthetic oligonucleotide
auccugauaaaaaauuuag

SEQ ID NO: 17447 - RNA, 19 nt, Artificial Sequence
  Synthetic oligonucleotide
uccugauaaaaaauuuagu

SEQ ID NO: 17448 - RNA, 19 nt, Artificial Sequence
  Synthetic oligonucleotide
ccugauaaaaaauuuaguu

SEQ ID NO: 17449 - RNA, 19 nt, Artificial Sequence
  Synthetic oligonucleotide
cugauaaaaaauuuaguua

SEQ ID NO: 17450 - RNA, 19 nt, Artificial Sequence
  Synthetic oligonucleotide
ugauaaaaaauuuaguuac

SEQ ID NO: 17451 - RNA, 19 nt, Artificial Sequence
  Synthetic oligonucleotide
gauaaaaaauuuaguuacu

SEQ ID NO: 17452 - RNA, 19 nt, Artificial Sequence
  Synthetic oligonucleotide
auaaaaaauuuaguuacuc

SEQ ID NO: 17453 - RNA, 19 nt, Artificial Sequence
  Synthetic oligonucleotide
uaaaaaauuuaguuacucc

SEQ ID NO: 17454 - RNA, 19 nt, Artificial Sequence
  Synthetic oligonucleotide
aaaaaauuuaguuacuccu

SEQ ID NO: 17455 - RNA, 19 nt, Artificial Sequence
  Synthetic oligonucleotide
aaaaauuuaguuacuccuc

SEQ ID NO: 17456 - RNA, 19 nt, Artificial Sequence
  Synthetic oligonucleotide
aaaauuuaguuacuccuca

SEQ ID NO: 17457 - RNA, 19 nt, Artificial Sequence
  Synthetic oligonucleotide
aaauuuaguuacuccucag

SEQ ID NO: 17458 - RNA, 19 nt, Artificial Sequence
  Synthetic oligonucleotide
aauuuaguuacuccucagg

SEQ ID NO: 17459 - RNA, 19 nt, Artificial Sequence
  Synthetic oligonucleotide
auuuaguuacuccucaggc

SEQ ID NO: 17460 - RNA, 19 nt, Artificial Sequence
  Synthetic oligonucleotide
uuuaguuacuccucaggcc

SEQ ID NO: 17461 - RNA, 19 nt, Artificial Sequence
  Synthetic oligonucleotide
uuaguuacuccucaggcca

SEQ ID NO: 17462 - RNA, 19 nt, Artificial Sequence
  Synthetic oligonucleotide
uaguuacuccucaggccau

SEQ ID NO: 17463 - RNA, 19 nt, Artificial Sequence
  Synthetic oligonucleotide
aguuacuccucaggccaug

SEQ ID NO: 17464 - RNA, 19 nt, Artificial Sequence
  Synthetic oligonucleotide
guuacuccucaggccaugu

SEQ ID NO: 17465 - RNA, 19 nt, Artificial Sequence
  Synthetic oligonucleotide
uuacuccucaggccauguu

SEQ ID NO: 17466 - RNA, 19 nt, Artificial Sequence
  Synthetic oligonucleotide
uacuccucaggccauguuc

SEQ ID NO: 17467 - RNA, 19 nt, Artificial Sequence
  Synthetic oligonucleotide
acuccucaggccauguuca

SEQ ID NO: 17468 - RNA, 19 nt, Artificial Sequence
  Synthetic oligonucleotide
cuccucaggccauguucau

SEQ ID NO: 17469 - RNA, 19 nt, Artificial Sequence
  Synthetic oligonucleotide
uccucaggccauguucauu

SEQ ID NO: 17470 - RNA, 19 nt, Artificial Sequence
  Synthetic oligonucleotide
ccucaggccauguucauuu

SEQ ID NO: 17471 - RNA, 19 nt, Artificial Sequence
  Synthetic oligonucleotide
cucaggccauguucauuua

SEQ ID NO: 17472 - RNA, 19 nt, Artificial Sequence
  Synthetic oligonucleotide
ucaggccauguucauuuau

SEQ ID NO: 17473 - RNA, 19 nt, Artificial Sequence
  Synthetic oligonucleotide
caggccauguucauuuauc

SEQ ID NO: 17474 - RNA, 19 nt, Artificial Sequence
  Synthetic oligonucleotide
aggccauguucauuuaucc

SEQ ID NO: 17475 - RNA, 19 nt, Artificial Sequence
  Synthetic oligonucleotide
ggccauguucauuuauccu

SEQ ID NO: 17476 - RNA, 19 nt, Artificial Sequence
  Synthetic oligonucleotide
gccauguucauuuauccuc

SEQ ID NO: 17477 - RNA, 19 nt, Artificial Sequence
  Synthetic oligonucleotide
ccauguucauuuauccuca

SEQ ID NO: 17478 - RNA, 19 nt, Artificial Sequence
  Synthetic oligonucleotide
cauguucauuuauccucag

SEQ ID NO: 17479 - RNA, 19 nt, Artificial Sequence
  Synthetic oligonucleotide
auguucauuuauccucaga

SEQ ID NO: 17480 - RNA, 19 nt, Artificial Sequence
  Synthetic oligonucleotide
uucauuuauccucagagaa

SEQ ID NO: 17481 - RNA, 19 nt, Artificial Sequence
  Synthetic oligonucleotide
ucauuuauccucagagaau

SEQ ID NO: 17482 - RNA, 19 nt, Artificial Sequence
  Synthetic oligonucleotide
cauuuauccucagagaaua

SEQ ID NO: 17483 - RNA, 19 nt, Artificial Sequence
  Synthetic oligonucleotide
auuuauccucagagaauaa

SEQ ID NO: 17484 - RNA, 19 nt, Artificial Sequence
  Synthetic oligonucleotide
uuuauccucagagaauaaa

SEQ ID NO: 17485 - RNA, 19 nt, Artificial Sequence
  Synthetic oligonucleotide
uuauccucagagaauaaau

SEQ ID NO: 17486 - RNA, 19 nt, Artificial Sequence
  Synthetic oligonucleotide
uauccucagagaauaaauu

SEQ ID NO: 17487 - RNA, 19 nt, Artificial Sequence
  Synthetic oligonucleotide
auccucagagaauaaauuc

SEQ ID NO: 17488 - RNA, 19 nt, Artificial Sequence
  Synthetic oligonucleotide
uccucagagaauaaauucc

SEQ ID NO: 17489 - RNA, 19 nt, Artificial Sequence
  Synthetic oligonucleotide
ccucagagaauaaauucca

SEQ ID NO: 17490 - RNA, 19 nt, Artificial Sequence
  Synthetic oligonucleotide
cucagagaauaaauuccaa

SEQ ID NO: 17491 - RNA, 19 nt, Artificial Sequence
  Synthetic oligonucleotide
ucagagaauaaauuccaaa

SEQ ID NO: 17492 - RNA, 19 nt, Artificial Sequence
  Synthetic oligonucleotide
cagagaauaaauuccaaaa

SEQ ID NO: 17493 - RNA, 19 nt, Artificial Sequence
  Synthetic oligonucleotide
agagaauaaauuccaaaac

SEQ ID NO: 17494 - RNA, 19 nt, Artificial Sequence
  Synthetic oligonucleotide
gagaauaaauuccaaaacu

SEQ ID NO: 17495 - RNA, 19 nt, Artificial Sequence
  Synthetic oligonucleotide
aucuuaacaauacaaccaa

SEQ ID NO: 17496 - RNA, 19 nt, Artificial Sequence
  Synthetic oligonucleotide
ucuuaacaauacaaccaaa

SEQ ID NO: 17497 - RNA, 19 nt, Artificial Sequence
  Synthetic oligonucleotide
cuuaacaauacaaccaaaa

SEQ ID NO: 17498 - RNA, 19 nt, Artificial Sequence
  Synthetic oligonucleotide
uuaacaauacaaccaaaac

SEQ ID NO: 17499 - RNA, 19 nt, Artificial Sequence
  Synthetic oligonucleotide
uaacaauacaaccaaaaca

SEQ ID NO: 17500 - RNA, 19 nt, Artificial Sequence
  Synthetic oligonucleotide
aacaauacaaccaaaacaa

SEQ ID NO: 17501 - RNA, 19 nt, Artificial Sequence
  Synthetic oligonucleotide
acaauacaaccaaaacaau

SEQ ID NO: 17502 - RNA, 19 nt, Artificial Sequence
  Synthetic oligonucleotide
uauuuggaaguuguaucaa

SEQ ID NO: 17503 - RNA, 19 nt, Artificial Sequence
  Synthetic oligonucleotide
auuuggaaguuguaucaaa

SEQ ID NO: 17504 - RNA, 19 nt, Artificial Sequence
  Synthetic oligonucleotide
guaucaaagcauuuuucaa

SEQ ID NO: 17505 - RNA, 19 nt, Artificial Sequence
  Synthetic oligonucleotide
uaucaaagcauuuuucaaa

SEQ ID NO: 17506 - RNA, 19 nt, Artificial Sequence
  Synthetic oligonucleotide
aucaaagcauuuuucaaaa

SEQ ID NO: 17507 - RNA, 19 nt, Artificial Sequence
  Synthetic oligonucleotide
ucaaagcauuuuucaaaau

SEQ ID NO: 17508 - RNA, 19 nt, Artificial Sequence
  Synthetic oligonucleotide
caaagcauuuuucaaaauc

SEQ ID NO: 17509 - RNA, 19 nt, Artificial Sequence
  Synthetic oligonucleotide
gccaauaaccuaugacaau

SEQ ID NO: 17510 - RNA, 19 nt, Artificial Sequence
  Synthetic oligonucleotide
ccaauaaccuaugacaaug

SEQ ID NO: 17511 - RNA, 19 nt, Artificial Sequence
  Synthetic oligonucleotide
aauaaccuaugacaaugga

SEQ ID NO: 17512 - RNA, 19 nt, Artificial Sequence
  Synthetic oligonucleotide
auaaccuaugacaauggau

SEQ ID NO: 17513 - RNA, 19 nt, Artificial Sequence
  Synthetic oligonucleotide
uaaccuaugacaauggauu

SEQ ID NO: 17514 - RNA, 19 nt, Artificial Sequence
  Synthetic oligonucleotide
aaccuaugacaauggauuu

SEQ ID NO: 17515 - RNA, 19 nt, Artificial Sequence
  Synthetic oligonucleotide
accuaugacaauggauuuc

SEQ ID NO: 17516 - RNA, 19 nt, Artificial Sequence
  Synthetic oligonucleotide
cuaugacaauggauuucuc

SEQ ID NO: 17517 - RNA, 19 nt, Artificial Sequence
  Synthetic oligonucleotide
uaugacaauggauuucucu

SEQ ID NO: 17518 - RNA, 19 nt, Artificial Sequence
  Synthetic oligonucleotide
augacaauggauuucucuu

SEQ ID NO: 17519 - RNA, 19 nt, Artificial Sequence
  Synthetic oligonucleotide
caauggauuucucuucauu

SEQ ID NO: 17520 - RNA, 19 nt, Artificial Sequence
  Synthetic oligonucleotide
uggauuucucuucauucau

SEQ ID NO: 17521 - RNA, 19 nt, Artificial Sequence
  Synthetic oligonucleotide
gauuucucuucauucauac

SEQ ID NO: 17522 - RNA, 19 nt, Artificial Sequence
  Synthetic oligonucleotide
auuucucuucauucauaca

SEQ ID NO: 17523 - RNA, 19 nt, Artificial Sequence
  Synthetic oligonucleotide
uuucucuucauucauacag

SEQ ID NO: 17524 - RNA, 19 nt, Artificial Sequence
  Synthetic oligonucleotide
uucucuucauucauacaga

SEQ ID NO: 17525 - RNA, 19 nt, Artificial Sequence
  Synthetic oligonucleotide
ucucuucauucauacagac

SEQ ID NO: 17526 - RNA, 19 nt, Artificial Sequence
  Synthetic oligonucleotide
cucuucauucauacagaca

SEQ ID NO: 17527 - RNA, 19 nt, Artificial Sequence
  Synthetic oligonucleotide
ucuucauucauacagacaa

SEQ ID NO: 17528 - RNA, 19 nt, Artificial Sequence
  Synthetic oligonucleotide
cuucauucauacagacaaa

SEQ ID NO: 17529 - RNA, 19 nt, Artificial Sequence
  Synthetic oligonucleotide
uucauucauacagacaaac

SEQ ID NO: 17530 - RNA, 19 nt, Artificial Sequence
  Synthetic oligonucleotide
ucauucauacagacaaacc

SEQ ID NO: 17531 - RNA, 19 nt, Artificial Sequence
  Synthetic oligonucleotide
auucauacagacaaaccug

SEQ ID NO: 17532 - RNA, 19 nt, Artificial Sequence
  Synthetic oligonucleotide
auacagacaaaccuguuua

SEQ ID NO: 17533 - RNA, 19 nt, Artificial Sequence
  Synthetic oligonucleotide
uacagacaaaccuguuuau

SEQ ID NO: 17534 - RNA, 19 nt, Artificial Sequence
  Synthetic oligonucleotide
acagacaaaccuguuuaua

SEQ ID NO: 17535 - RNA, 19 nt, Artificial Sequence
  Synthetic oligonucleotide
cagacaaaccuguuuauac

SEQ ID NO: 17536 - RNA, 19 nt, Artificial Sequence
  Synthetic oligonucleotide
agacaaaccuguuuauacu

SEQ ID NO: 17537 - RNA, 19 nt, Artificial Sequence
  Synthetic oligonucleotide
gacaaaccuguuuauacuc

SEQ ID NO: 17538 - RNA, 19 nt, Artificial Sequence
  Synthetic oligonucleotide
acaaaccuguuuauacucc

SEQ ID NO: 17539 - RNA, 19 nt, Artificial Sequence
  Synthetic oligonucleotide
caaaccuguuuauacucca

SEQ ID NO: 17540 - RNA, 19 nt, Artificial Sequence
  Synthetic oligonucleotide
aaaccuguuuauacuccag

SEQ ID NO: 17541 - RNA, 19 nt, Artificial Sequence
  Synthetic oligonucleotide
aaccuguuuauacuccaga

SEQ ID NO: 17542 - RNA, 19 nt, Artificial Sequence
  Synthetic oligonucleotide
accuguuuauacuccagac

SEQ ID NO: 17543 - RNA, 19 nt, Artificial Sequence
  Synthetic oligonucleotide
ccuguuuauacuccagacc

SEQ ID NO: 17544 - RNA, 19 nt, Artificial Sequence
  Synthetic oligonucleotide
guuagaguuuauucguuga

SEQ ID NO: 17545 - RNA, 19 nt, Artificial Sequence
  Synthetic oligonucleotide
uuagaguuuauucguugaa

SEQ ID NO: 17546 - RNA, 19 nt, Artificial Sequence
  Synthetic oligonucleotide
uagaguuuauucguugaau

SEQ ID NO: 17547 - RNA, 19 nt, Artificial Sequence
  Synthetic oligonucleotide
agaguuuauucguugaaug

SEQ ID NO: 17548 - RNA, 19 nt, Artificial Sequence
  Synthetic oligonucleotide
cgacuugaagccagccaaa

SEQ ID NO: 17549 - RNA, 19 nt, Artificial Sequence
  Synthetic oligonucleotide
gacuugaagccagccaaaa

SEQ ID NO: 17550 - RNA, 19 nt, Artificial Sequence
  Synthetic oligonucleotide
acuugaagccagccaaaag

SEQ ID NO: 17551 - RNA, 19 nt, Artificial Sequence
  Synthetic oligonucleotide
cuugaagccagccaaaaga

SEQ ID NO: 17552 - RNA, 19 nt, Artificial Sequence
  Synthetic oligonucleotide
uugaagccagccaaaagag

SEQ ID NO: 17553 - RNA, 19 nt, Artificial Sequence
  Synthetic oligonucleotide
ugaagccagccaaaagaga

SEQ ID NO: 17554 - RNA, 19 nt, Artificial Sequence
  Synthetic oligonucleotide
gaagccagccaaaagagaa

SEQ ID NO: 17555 - RNA, 19 nt, Artificial Sequence
  Synthetic oligonucleotide
aagccagccaaaagagaaa

SEQ ID NO: 17556 - RNA, 19 nt, Artificial Sequence
  Synthetic oligonucleotide
agccagccaaaagagaaac

SEQ ID NO: 17557 - RNA, 19 nt, Artificial Sequence
  Synthetic oligonucleotide
gccagccaaaagagaaacu

SEQ ID NO: 17558 - RNA, 19 nt, Artificial Sequence
  Synthetic oligonucleotide
ccagccaaaagagaaacug

SEQ ID NO: 17559 - RNA, 19 nt, Artificial Sequence
  Synthetic oligonucleotide
cagccaaaagagaaacugu

SEQ ID NO: 17560 - RNA, 19 nt, Artificial Sequence
  Synthetic oligonucleotide
agccaaaagagaaacuguc

SEQ ID NO: 17561 - RNA, 19 nt, Artificial Sequence
  Synthetic oligonucleotide
gccaaaagagaaacugucu

SEQ ID NO: 17562 - RNA, 19 nt, Artificial Sequence
  Synthetic oligonucleotide
ccaaaagagaaacugucuu

SEQ ID NO: 17563 - RNA, 19 nt, Artificial Sequence
  Synthetic oligonucleotide
caaaagagaaacugucuua

SEQ ID NO: 17564 - RNA, 19 nt, Artificial Sequence
  Synthetic oligonucleotide
aaaagagaaacugucuuaa

SEQ ID NO: 17565 - RNA, 19 nt, Artificial Sequence
  Synthetic oligonucleotide
aaagagaaacugucuuaac

SEQ ID NO: 17566 - RNA, 19 nt, Artificial Sequence
  Synthetic oligonucleotide
aagagaaacugucuuaacu

SEQ ID NO: 17567 - RNA, 19 nt, Artificial Sequence
  Synthetic oligonucleotide
agagaaacugucuuaacuu

SEQ ID NO: 17568 - RNA, 19 nt, Artificial Sequence
  Synthetic oligonucleotide
agaaacugucuuaacuuuc

SEQ ID NO: 17569 - RNA, 19 nt, Artificial Sequence
  Synthetic oligonucleotide
gaaacugucuuaacuuuca

SEQ ID NO: 17570 - RNA, 19 nt, Artificial Sequence
  Synthetic oligonucleotide
aaacugucuuaacuuucau

SEQ ID NO: 17571 - RNA, 19 nt, Artificial Sequence
  Synthetic oligonucleotide
cugucuuaacuuucauaga

SEQ ID NO: 17572 - RNA, 19 nt, Artificial Sequence
  Synthetic oligonucleotide
ugucuuaacuuucauagau

SEQ ID NO: 17573 - RNA, 19 nt, Artificial Sequence
  Synthetic oligonucleotide
gucuuaacuuucauagauc

SEQ ID NO: 17574 - RNA, 19 nt, Artificial Sequence
  Synthetic oligonucleotide
ucuuaacuuucauagaucc

SEQ ID NO: 17575 - RNA, 19 nt, Artificial Sequence
  Synthetic oligonucleotide
cuuaacuuucauagauccu

SEQ ID NO: 17576 - RNA, 19 nt, Artificial Sequence
  Synthetic oligonucleotide
uuaacuuucauagauccug

SEQ ID NO: 17577 - RNA, 19 nt, Artificial Sequence
  Synthetic oligonucleotide
uaacuuucauagauccuga

SEQ ID NO: 17578 - RNA, 19 nt, Artificial Sequence
  Synthetic oligonucleotide
aacuuucauagauccugaa

SEQ ID NO: 17579 - RNA, 19 nt, Artificial Sequence
  Synthetic oligonucleotide
acuuucauagauccugaag

SEQ ID NO: 17580 - RNA, 19 nt, Artificial Sequence
  Synthetic oligonucleotide
cuuucauagauccugaagg

SEQ ID NO: 17581 - RNA, 19 nt, Artificial Sequence
  Synthetic oligonucleotide
uuucauagauccugaagga

SEQ ID NO: 17582 - RNA, 19 nt, Artificial Sequence
  Synthetic oligonucleotide
uucauagauccugaaggau

SEQ ID NO: 17583 - RNA, 19 nt, Artificial Sequence
  Synthetic oligonucleotide
ucauagauccugaaggauc

SEQ ID NO: 17584 - RNA, 19 nt, Artificial Sequence
  Synthetic oligonucleotide
cauagauccugaaggauca

SEQ ID NO: 17585 - RNA, 19 nt, Artificial Sequence
  Synthetic oligonucleotide
auagauccugaaggaucag

SEQ ID NO: 17586 - RNA, 19 nt, Artificial Sequence
  Synthetic oligonucleotide
uagauccugaaggaucaga

SEQ ID NO: 17587 - RNA, 19 nt, Artificial Sequence
  Synthetic oligonucleotide
guugacaugguagaagaaa

SEQ ID NO: 17588 - RNA, 19 nt, Artificial Sequence
  Synthetic oligonucleotide
uugacaugguagaagaaau

SEQ ID NO: 17589 - RNA, 19 nt, Artificial Sequence
  Synthetic oligonucleotide
acaugguagaagaaauuga

SEQ ID NO: 17590 - RNA, 19 nt, Artificial Sequence
  Synthetic oligonucleotide
caugguagaagaaauugau

SEQ ID NO: 17591 - RNA, 19 nt, Artificial Sequence
  Synthetic oligonucleotide
augguagaagaaauugauc

SEQ ID NO: 17592 - RNA, 19 nt, Artificial Sequence
  Synthetic oligonucleotide
guagaagaaauugaucaua

SEQ ID NO: 17593 - RNA, 19 nt, Artificial Sequence
  Synthetic oligonucleotide
uagaagaaauugaucauau

SEQ ID NO: 17594 - RNA, 19 nt, Artificial Sequence
  Synthetic oligonucleotide
agaagaaauugaucauauu

SEQ ID NO: 17595 - RNA, 19 nt, Artificial Sequence
  Synthetic oligonucleotide
agaaauugaucauauugga

SEQ ID NO: 17596 - RNA, 19 nt, Artificial Sequence
  Synthetic oligonucleotide
gaaauugaucauauuggaa

SEQ ID NO: 17597 - RNA, 19 nt, Artificial Sequence
  Synthetic oligonucleotide
aaauugaucauauuggaau

SEQ ID NO: 17598 - RNA, 19 nt, Artificial Sequence
  Synthetic oligonucleotide
aauugaucauauuggaauu

SEQ ID NO: 17599 - RNA, 19 nt, Artificial Sequence
  Synthetic oligonucleotide
auugaucauauuggaauua

SEQ ID NO: 17600 - RNA, 19 nt, Artificial Sequence
  Synthetic oligonucleotide
uugaucauauuggaauuau

SEQ ID NO: 17601 - RNA, 19 nt, Artificial Sequence
  Synthetic oligonucleotide
ugaucauauuggaauuauc

SEQ ID NO: 17602 - RNA, 19 nt, Artificial Sequence
  Synthetic oligonucleotide
gaucauauuggaauuaucu

SEQ ID NO: 17603 - RNA, 19 nt, Artificial Sequence
  Synthetic oligonucleotide
aucauauuggaauuaucuc

SEQ ID NO: 17604 - RNA, 19 nt, Artificial Sequence
  Synthetic oligonucleotide
ucauauuggaauuaucucu

SEQ ID NO: 17605 - RNA, 19 nt, Artificial Sequence
  Synthetic oligonucleotide
cauauuggaauuaucucuu

SEQ ID NO: 17606 - RNA, 19 nt, Artificial Sequence
  Synthetic oligonucleotide
auauuggaauuaucucuuu

SEQ ID NO: 17607 - RNA, 19 nt, Artificial Sequence
  Synthetic oligonucleotide
uauuggaauuaucucuuuu

SEQ ID NO: 17608 - RNA, 19 nt, Artificial Sequence
  Synthetic oligonucleotide
auuggaauuaucucuuuuc

SEQ ID NO: 17609 - RNA, 19 nt, Artificial Sequence
  Synthetic oligonucleotide
uuggaauuaucucuuuucc

SEQ ID NO: 17610 - RNA, 19 nt, Artificial Sequence
  Synthetic oligonucleotide
uuccugacuucaagauucc

SEQ ID NO: 17611 - RNA, 19 nt, Artificial Sequence
  Synthetic oligonucleotide
uccugacuucaagauuccg

SEQ ID NO: 17612 - RNA, 19 nt, Artificial Sequence
  Synthetic oligonucleotide
ccugacuucaagauuccgu

SEQ ID NO: 17613 - RNA, 19 nt, Artificial Sequence
  Synthetic oligonucleotide
cugacuucaagauuccguc

SEQ ID NO: 17614 - RNA, 19 nt, Artificial Sequence
  Synthetic oligonucleotide
ugacuucaagauuccgucu

SEQ ID NO: 17615 - RNA, 19 nt, Artificial Sequence
  Synthetic oligonucleotide
gacuucaagauuccgucua

SEQ ID NO: 17616 - RNA, 19 nt, Artificial Sequence
  Synthetic oligonucleotide
acuucaagauuccgucuaa

SEQ ID NO: 17617 - RNA, 19 nt, Artificial Sequence
  Synthetic oligonucleotide
cuucaagauuccgucuaau

SEQ ID NO: 17618 - RNA, 19 nt, Artificial Sequence
  Synthetic oligonucleotide
uucaagauuccgucuaauc

SEQ ID NO: 17619 - RNA, 19 nt, Artificial Sequence
  Synthetic oligonucleotide
ucaagauuccgucuaaucc

SEQ ID NO: 17620 - RNA, 19 nt, Artificial Sequence
  Synthetic oligonucleotide
caagauuccgucuaauccu

SEQ ID NO: 17621 - RNA, 19 nt, Artificial Sequence
  Synthetic oligonucleotide
aagauuccgucuaauccua

SEQ ID NO: 17622 - RNA, 19 nt, Artificial Sequence
  Synthetic oligonucleotide
agauuccgucuaauccuag

SEQ ID NO: 17623 - RNA, 19 nt, Artificial Sequence
  Synthetic oligonucleotide
gauuccgucuaauccuaga

SEQ ID NO: 17624 - RNA, 19 nt, Artificial Sequence
  Synthetic oligonucleotide
auuccgucuaauccuagau

SEQ ID NO: 17625 - RNA, 19 nt, Artificial Sequence
  Synthetic oligonucleotide
uuccgucuaauccuagaua

SEQ ID NO: 17626 - RNA, 19 nt, Artificial Sequence
  Synthetic oligonucleotide
uccgucuaauccuagauau

SEQ ID NO: 17627 - RNA, 19 nt, Artificial Sequence
  Synthetic oligonucleotide
ccgucuaauccuagauaug

SEQ ID NO: 17628 - RNA, 19 nt, Artificial Sequence
  Synthetic oligonucleotide
cgucuaauccuagauaugg

SEQ ID NO: 17629 - RNA, 19 nt, Artificial Sequence
  Synthetic oligonucleotide
gucuaauccuagauauggu

SEQ ID NO: 17630 - RNA, 19 nt, Artificial Sequence
  Synthetic oligonucleotide
ucuaauccuagauauggua

SEQ ID NO: 17631 - RNA, 19 nt, Artificial Sequence
  Synthetic oligonucleotide
cuaauccuagauaugguau

SEQ ID NO: 17632 - RNA, 19 nt, Artificial Sequence
  Synthetic oligonucleotide
uaauccuagauaugguaug

SEQ ID NO: 17633 - RNA, 19 nt, Artificial Sequence
  Synthetic oligonucleotide
aauccuagauaugguaugu

SEQ ID NO: 17634 - RNA, 19 nt, Artificial Sequence
  Synthetic oligonucleotide
auccuagauaugguaugug

SEQ ID NO: 17635 - RNA, 19 nt, Artificial Sequence
  Synthetic oligonucleotide
uccuagauaugguaugugg

SEQ ID NO: 17636 - RNA, 19 nt, Artificial Sequence
  Synthetic oligonucleotide
aaggcuaaauauaaagagg

SEQ ID NO: 17637 - RNA, 19 nt, Artificial Sequence
  Synthetic oligonucleotide
aggcuaaauauaaagagga

SEQ ID NO: 17638 - RNA, 19 nt, Artificial Sequence
  Synthetic oligonucleotide
ggcuaaauauaaagaggac

SEQ ID NO: 17639 - RNA, 19 nt, Artificial Sequence
  Synthetic oligonucleotide
gcuaaauauaaagaggacu

SEQ ID NO: 17640 - RNA, 19 nt, Artificial Sequence
  Synthetic oligonucleotide
cuaaauauaaagaggacuu

SEQ ID NO: 17641 - RNA, 19 nt, Artificial Sequence
  Synthetic oligonucleotide
uaaauauaaagaggacuuu

SEQ ID NO: 17642 - RNA, 19 nt, Artificial Sequence
  Synthetic oligonucleotide
aaauauaaagaggacuuuu

SEQ ID NO: 17643 - RNA, 19 nt, Artificial Sequence
  Synthetic oligonucleotide
aauauaaagaggacuuuuc

SEQ ID NO: 17644 - RNA, 19 nt, Artificial Sequence
  Synthetic oligonucleotide
auauaaagaggacuuuuca

SEQ ID NO: 17645 - RNA, 19 nt, Artificial Sequence
  Synthetic oligonucleotide
uauaaagaggacuuuucaa

SEQ ID NO: 17646 - RNA, 19 nt, Artificial Sequence
  Synthetic oligonucleotide
auaaagaggacuuuucaac

SEQ ID NO: 17647 - RNA, 19 nt, Artificial Sequence
  Synthetic oligonucleotide
uaaagaggacuuuucaaca

SEQ ID NO: 17648 - RNA, 19 nt, Artificial Sequence
  Synthetic oligonucleotide
aaagaggacuuuucaacaa

SEQ ID NO: 17649 - RNA, 19 nt, Artificial Sequence
  Synthetic oligonucleotide
aagaggacuuuucaacaac

SEQ ID NO: 17650 - RNA, 19 nt, Artificial Sequence
  Synthetic oligonucleotide
agaggacuuuucaacaacu

SEQ ID NO: 17651 - RNA, 19 nt, Artificial Sequence
  Synthetic oligonucleotide
gaggacuuuucaacaacug

SEQ ID NO: 17652 - RNA, 19 nt, Artificial Sequence
  Synthetic oligonucleotide
aggacuuuucaacaacugg

SEQ ID NO: 17653 - RNA, 19 nt, Artificial Sequence
  Synthetic oligonucleotide
ggacuuuucaacaacugga

SEQ ID NO: 17654 - RNA, 19 nt, Artificial Sequence
  Synthetic oligonucleotide
gacuuuucaacaacuggaa

SEQ ID NO: 17655 - RNA, 19 nt, Artificial Sequence
  Synthetic oligonucleotide
auuuugaaguuaaagaaua

SEQ ID NO: 17656 - RNA, 19 nt, Artificial Sequence
  Synthetic oligonucleotide
uuuugaaguuaaagaauau

SEQ ID NO: 17657 - RNA, 19 nt, Artificial Sequence
  Synthetic oligonucleotide
uuugaaguuaaagaauaug

SEQ ID NO: 17658 - RNA, 19 nt, Artificial Sequence
  Synthetic oligonucleotide
uugaaguuaaagaauaugu

SEQ ID NO: 17659 - RNA, 19 nt, Artificial Sequence
  Synthetic oligonucleotide
ugaaguuaaagaauauguc

SEQ ID NO: 17660 - RNA, 19 nt, Artificial Sequence
  Synthetic oligonucleotide
gaaguuaaagaauaugucu

SEQ ID NO: 17661 - RNA, 19 nt, Artificial Sequence
  Synthetic oligonucleotide
aaguuaaagaauaugucuu

SEQ ID NO: 17662 - RNA, 19 nt, Artificial Sequence
  Synthetic oligonucleotide
aguuaaagaauaugucuug

SEQ ID NO: 17663 - RNA, 19 nt, Artificial Sequence
  Synthetic oligonucleotide
aaagaauaugucuugccac

SEQ ID NO: 17664 - RNA, 19 nt, Artificial Sequence
  Synthetic oligonucleotide
aagaauaugucuugccaca

SEQ ID NO: 17665 - RNA, 19 nt, Artificial Sequence
  Synthetic oligonucleotide
agaauaugucuugccacau

SEQ ID NO: 17666 - RNA, 19 nt, Artificial Sequence
  Synthetic oligonucleotide
gaauaugucuugccacauu

SEQ ID NO: 17667 - RNA, 19 nt, Artificial Sequence
  Synthetic oligonucleotide
aauaugucuugccacauuu

SEQ ID NO: 17668 - RNA, 19 nt, Artificial Sequence
  Synthetic oligonucleotide
auaugucuugccacauuuu

SEQ ID NO: 17669 - RNA, 19 nt, Artificial Sequence
  Synthetic oligonucleotide
uaugucuugccacauuuuu

SEQ ID NO: 17670 - RNA, 19 nt, Artificial Sequence
  Synthetic oligonucleotide
augucuugccacauuuuuc

SEQ ID NO: 17671 - RNA, 19 nt, Artificial Sequence
  Synthetic oligonucleotide
ugucuugccacauuuuucu

SEQ ID NO: 17672 - RNA, 19 nt, Artificial Sequence
  Synthetic oligonucleotide
gucuugccacauuuuucug

SEQ ID NO: 17673 - RNA, 19 nt, Artificial Sequence
  Synthetic oligonucleotide
ucuugccacauuuuucugu

SEQ ID NO: 17674 - RNA, 19 nt, Artificial Sequence
  Synthetic oligonucleotide
cuugccacauuuuucuguc

SEQ ID NO: 17675 - RNA, 19 nt, Artificial Sequence
  Synthetic oligonucleotide
uugccacauuuuucugucu

SEQ ID NO: 17676 - RNA, 19 nt, Artificial Sequence
  Synthetic oligonucleotide
ugccacauuuuucugucuc

SEQ ID NO: 17677 - RNA, 19 nt, Artificial Sequence
  Synthetic oligonucleotide
agaacuuuaagaauuuuga

SEQ ID NO: 17678 - RNA, 19 nt, Artificial Sequence
  Synthetic oligonucleotide
gaacuuuaagaauuuugaa

SEQ ID NO: 17679 - RNA, 19 nt, Artificial Sequence
  Synthetic oligonucleotide
aacuuuaagaauuuugaaa

SEQ ID NO: 17680 - RNA, 19 nt, Artificial Sequence
  Synthetic oligonucleotide
cuuuaagaauuuugaaauu

SEQ ID NO: 17681 - RNA, 19 nt, Artificial Sequence
  Synthetic oligonucleotide
uuuaagaauuuugaaauua

SEQ ID NO: 17682 - RNA, 19 nt, Artificial Sequence
  Synthetic oligonucleotide
uuaagaauuuugaaauuac

SEQ ID NO: 17683 - RNA, 19 nt, Artificial Sequence
  Synthetic oligonucleotide
uaagaauuuugaaauuacu

SEQ ID NO: 17684 - RNA, 19 nt, Artificial Sequence
  Synthetic oligonucleotide
aagaauuuugaaauuacua

SEQ ID NO: 17685 - RNA, 19 nt, Artificial Sequence
  Synthetic oligonucleotide
auuuugaaauuacuauaaa

SEQ ID NO: 17686 - RNA, 19 nt, Artificial Sequence
  Synthetic oligonucleotide
uuuugaaauuacuauaaaa

SEQ ID NO: 17687 - RNA, 19 nt, Artificial Sequence
  Synthetic oligonucleotide
gaaauuacuauaaaagcaa

SEQ ID NO: 17688 - RNA, 19 nt, Artificial Sequence
  Synthetic oligonucleotide
aaauuacuauaaaagcaag

SEQ ID NO: 17689 - RNA, 19 nt, Artificial Sequence
  Synthetic oligonucleotide
aauuacuauaaaagcaaga

SEQ ID NO: 17690 - RNA, 19 nt, Artificial Sequence
  Synthetic oligonucleotide
auuacuauaaaagcaagau

SEQ ID NO: 17691 - RNA, 19 nt, Artificial Sequence
  Synthetic oligonucleotide
uuacuauaaaagcaagaua

SEQ ID NO: 17692 - RNA, 19 nt, Artificial Sequence
  Synthetic oligonucleotide
uacuauaaaagcaagauau

SEQ ID NO: 17693 - RNA, 19 nt, Artificial Sequence
  Synthetic oligonucleotide
acuauaaaagcaagauauu

SEQ ID NO: 17694 - RNA, 19 nt, Artificial Sequence
  Synthetic oligonucleotide
cuauaaaagcaagauauuu

SEQ ID NO: 17695 - RNA, 19 nt, Artificial Sequence
  Synthetic oligonucleotide
uauaaaagcaagauauuuu

SEQ ID NO: 17696 - RNA, 19 nt, Artificial Sequence
  Synthetic oligonucleotide
auaaaagcaagauauuuuu

SEQ ID NO: 17697 - RNA, 19 nt, Artificial Sequence
  Synthetic oligonucleotide
uaaaagcaagauauuuuua

SEQ ID NO: 17698 - RNA, 19 nt, Artificial Sequence
  Synthetic oligonucleotide
gauauuuuuauaauaaagu

SEQ ID NO: 17699 - RNA, 19 nt, Artificial Sequence
  Synthetic oligonucleotide
auauuuuuauaauaaagua

SEQ ID NO: 17700 - RNA, 19 nt, Artificial Sequence
  Synthetic oligonucleotide
uauuuuuauaauaaaguag

SEQ ID NO: 17701 - RNA, 19 nt, Artificial Sequence
  Synthetic oligonucleotide
auuuuuauaauaaaguagu

SEQ ID NO: 17702 - RNA, 19 nt, Artificial Sequence
  Synthetic oligonucleotide
uuuuuauaauaaaguaguc

SEQ ID NO: 17703 - RNA, 19 nt, Artificial Sequence
  Synthetic oligonucleotide
uuuuauaauaaaguaguca

SEQ ID NO: 17704 - RNA, 19 nt, Artificial Sequence
  Synthetic oligonucleotide
uuuauaauaaaguagucac

SEQ ID NO: 17705 - RNA, 19 nt, Artificial Sequence
  Synthetic oligonucleotide
uuauaauaaaguagucacu

SEQ ID NO: 17706 - RNA, 19 nt, Artificial Sequence
  Synthetic oligonucleotide
uauaauaaaguagucacug

SEQ ID NO: 17707 - RNA, 19 nt, Artificial Sequence
  Synthetic oligonucleotide
auaauaaaguagucacuga

SEQ ID NO: 17708 - RNA, 19 nt, Artificial Sequence
  Synthetic oligonucleotide
uaauaaaguagucacugag

SEQ ID NO: 17709 - RNA, 19 nt, Artificial Sequence
  Synthetic oligonucleotide
aauaaaguagucacugagg

SEQ ID NO: 17710 - RNA, 19 nt, Artificial Sequence
  Synthetic oligonucleotide
auaaaguagucacugaggc

SEQ ID NO: 17711 - RNA, 19 nt, Artificial Sequence
  Synthetic oligonucleotide
uaaaguagucacugaggcu

SEQ ID NO: 17712 - RNA, 19 nt, Artificial Sequence
  Synthetic oligonucleotide
aaaguagucacugaggcug

SEQ ID NO: 17713 - RNA, 19 nt, Artificial Sequence
  Synthetic oligonucleotide
cguuuauaucacauuugga

SEQ ID NO: 17714 - RNA, 19 nt, Artificial Sequence
  Synthetic oligonucleotide
guuuauaucacauuuggaa

SEQ ID NO: 17715 - RNA, 19 nt, Artificial Sequence
  Synthetic oligonucleotide
uuuauaucacauuuggaau

SEQ ID NO: 17716 - RNA, 19 nt, Artificial Sequence
  Synthetic oligonucleotide
uuauaucacauuuggaaua

SEQ ID NO: 17717 - RNA, 19 nt, Artificial Sequence
  Synthetic oligonucleotide
uauaucacauuuggaauaa

SEQ ID NO: 17718 - RNA, 19 nt, Artificial Sequence
  Synthetic oligonucleotide
auaucacauuuggaauaag

SEQ ID NO: 17719 - RNA, 19 nt, Artificial Sequence
  Synthetic oligonucleotide
uaucacauuuggaauaaga

SEQ ID NO: 17720 - RNA, 19 nt, Artificial Sequence
  Synthetic oligonucleotide
aucacauuuggaauaagag

SEQ ID NO: 17721 - RNA, 19 nt, Artificial Sequence
  Synthetic oligonucleotide
ucacauuuggaauaagaga

SEQ ID NO: 17722 - RNA, 19 nt, Artificial Sequence
  Synthetic oligonucleotide
cacauuuggaauaagagaa

SEQ ID NO: 17723 - RNA, 19 nt, Artificial Sequence
  Synthetic oligonucleotide
acauuuggaauaagagaag

SEQ ID NO: 17724 - RNA, 19 nt, Artificial Sequence
  Synthetic oligonucleotide
cauuuggaauaagagaaga

SEQ ID NO: 17725 - RNA, 19 nt, Artificial Sequence
  Synthetic oligonucleotide
auuuggaauaagagaagac

SEQ ID NO: 17726 - RNA, 19 nt, Artificial Sequence
  Synthetic oligonucleotide
uuuggaauaagagaagacu

SEQ ID NO: 17727 - RNA, 19 nt, Artificial Sequence
  Synthetic oligonucleotide
uuggaauaagagaagacuu

SEQ ID NO: 17728 - RNA, 19 nt, Artificial Sequence
  Synthetic oligonucleotide
uggaauaagagaagacuua

SEQ ID NO: 17729 - RNA, 19 nt, Artificial Sequence
  Synthetic oligonucleotide
ggaauaagagaagacuuaa

SEQ ID NO: 17730 - RNA, 19 nt, Artificial Sequence
  Synthetic oligonucleotide
gaauaagagaagacuuaaa

SEQ ID NO: 17731 - RNA, 19 nt, Artificial Sequence
  Synthetic oligonucleotide
aauaagagaagacuuaaaa

SEQ ID NO: 17732 - RNA, 19 nt, Artificial Sequence
  Synthetic oligonucleotide
auaagagaagacuuaaaag

SEQ ID NO: 17733 - RNA, 19 nt, Artificial Sequence
  Synthetic oligonucleotide
uaagagaagacuuaaaaga

SEQ ID NO: 17734 - RNA, 19 nt, Artificial Sequence
  Synthetic oligonucleotide
aagagaagacuuaaaagau

SEQ ID NO: 17735 - RNA, 19 nt, Artificial Sequence
  Synthetic oligonucleotide
agagaagacuuaaaagaug

SEQ ID NO: 17736 - RNA, 19 nt, Artificial Sequence
  Synthetic oligonucleotide
gagaagacuuaaaagauga

SEQ ID NO: 17737 - RNA, 19 nt, Artificial Sequence
  Synthetic oligonucleotide
agaagacuuaaaagaugau

SEQ ID NO: 17738 - RNA, 19 nt, Artificial Sequence
  Synthetic oligonucleotide
gaagacuuaaaagaugauc

SEQ ID NO: 17739 - RNA, 19 nt, Artificial Sequence
  Synthetic oligonucleotide
aagacuuaaaagaugauca

SEQ ID NO: 17740 - RNA, 19 nt, Artificial Sequence
  Synthetic oligonucleotide
agacuuaaaagaugaucaa

SEQ ID NO: 17741 - RNA, 19 nt, Artificial Sequence
  Synthetic oligonucleotide
gacuuaaaagaugaucaaa

SEQ ID NO: 17742 - RNA, 19 nt, Artificial Sequence
  Synthetic oligonucleotide
acuuaaaagaugaucaaaa

SEQ ID NO: 17743 - RNA, 19 nt, Artificial Sequence
  Synthetic oligonucleotide
cuuaaaagaugaucaaaaa

SEQ ID NO: 17744 - RNA, 19 nt, Artificial Sequence
  Synthetic oligonucleotide
uuaaaagaugaucaaaaag

SEQ ID NO: 17745 - RNA, 19 nt, Artificial Sequence
  Synthetic oligonucleotide
uaaaagaugaucaaaaaga

SEQ ID NO: 17746 - RNA, 19 nt, Artificial Sequence
  Synthetic oligonucleotide
aaaagaugaucaaaaagaa

SEQ ID NO: 17747 - RNA, 19 nt, Artificial Sequence
  Synthetic oligonucleotide
aaagaugaucaaaaagaaa

SEQ ID NO: 17748 - RNA, 19 nt, Artificial Sequence
  Synthetic oligonucleotide
aagaugaucaaaaagaaau

SEQ ID NO: 17749 - RNA, 19 nt, Artificial Sequence
  Synthetic oligonucleotide
agaugaucaaaaagaaaug

SEQ ID NO: 17750 - RNA, 19 nt, Artificial Sequence
  Synthetic oligonucleotide
gaugaucaaaaagaaauga

SEQ ID NO: 17751 - RNA, 19 nt, Artificial Sequence
  Synthetic oligonucleotide
augaucaaaaagaaaugau

SEQ ID NO: 17752 - RNA, 19 nt, Artificial Sequence
  Synthetic oligonucleotide
ugaucaaaaagaaaugaug

SEQ ID NO: 17753 - RNA, 19 nt, Artificial Sequence
  Synthetic oligonucleotide
gaucaaaaagaaaugaugc

SEQ ID NO: 17754 - RNA, 19 nt, Artificial Sequence
  Synthetic oligonucleotide
aucaaaaagaaaugaugca

SEQ ID NO: 17755 - RNA, 19 nt, Artificial Sequence
  Synthetic oligonucleotide
ucaaaaagaaaugaugcaa

SEQ ID NO: 17756 - RNA, 19 nt, Artificial Sequence
  Synthetic oligonucleotide
caaaaagaaaugaugcaaa

SEQ ID NO: 17757 - RNA, 19 nt, Artificial Sequence
  Synthetic oligonucleotide
aaaaagaaaugaugcaaac

SEQ ID NO: 17758 - RNA, 19 nt, Artificial Sequence
  Synthetic oligonucleotide
aaaagaaaugaugcaaaca

SEQ ID NO: 17759 - RNA, 19 nt, Artificial Sequence
  Synthetic oligonucleotide
aaagaaaugaugcaaacag

SEQ ID NO: 17760 - RNA, 19 nt, Artificial Sequence
  Synthetic oligonucleotide
aagaaaugaugcaaacagc

SEQ ID NO: 17761 - RNA, 19 nt, Artificial Sequence
  Synthetic oligonucleotide
agaaaugaugcaaacagca

SEQ ID NO: 17762 - RNA, 19 nt, Artificial Sequence
  Synthetic oligonucleotide
gaaaugaugcaaacagcaa

SEQ ID NO: 17763 - RNA, 19 nt, Artificial Sequence
  Synthetic oligonucleotide
aaaugaugcaaacagcaau

SEQ ID NO: 17764 - RNA, 19 nt, Artificial Sequence
  Synthetic oligonucleotide
aaugaugcaaacagcaaug

SEQ ID NO: 17765 - RNA, 19 nt, Artificial Sequence
  Synthetic oligonucleotide
augaugcaaacagcaaugc

SEQ ID NO: 17766 - RNA, 19 nt, Artificial Sequence
  Synthetic oligonucleotide
aauguugauaaauggaauu

SEQ ID NO: 17767 - RNA, 19 nt, Artificial Sequence
  Synthetic oligonucleotide
uugauaaauggaauugcuc

SEQ ID NO: 17768 - RNA, 19 nt, Artificial Sequence
  Synthetic oligonucleotide
ugauaaauggaauugcuca

SEQ ID NO: 17769 - RNA, 19 nt, Artificial Sequence
  Synthetic oligonucleotide
auaaauggaauugcucaag

SEQ ID NO: 17770 - RNA, 19 nt, Artificial Sequence
  Synthetic oligonucleotide
uaaauggaauugcucaagu

SEQ ID NO: 17771 - RNA, 19 nt, Artificial Sequence
  Synthetic oligonucleotide
aaauggaauugcucaaguc

SEQ ID NO: 17772 - RNA, 19 nt, Artificial Sequence
  Synthetic oligonucleotide
auggaauugcucaagucac

SEQ ID NO: 17773 - RNA, 19 nt, Artificial Sequence
  Synthetic oligonucleotide
uggaauugcucaagucaca

SEQ ID NO: 17774 - RNA, 19 nt, Artificial Sequence
  Synthetic oligonucleotide
ggaauugcucaagucacau

SEQ ID NO: 17775 - RNA, 19 nt, Artificial Sequence
  Synthetic oligonucleotide
gaauugcucaagucacauu

SEQ ID NO: 17776 - RNA, 19 nt, Artificial Sequence
  Synthetic oligonucleotide
aauugcucaagucacauuu

SEQ ID NO: 17777 - RNA, 19 nt, Artificial Sequence
  Synthetic oligonucleotide
auugcucaagucacauuug

SEQ ID NO: 17778 - RNA, 19 nt, Artificial Sequence
  Synthetic oligonucleotide
uugcucaagucacauuuga

SEQ ID NO: 17779 - RNA, 19 nt, Artificial Sequence
  Synthetic oligonucleotide
ugcucaagucacauuugau

SEQ ID NO: 17780 - RNA, 19 nt, Artificial Sequence
  Synthetic oligonucleotide
cucaagucacauuugauuc

SEQ ID NO: 17781 - RNA, 19 nt, Artificial Sequence
  Synthetic oligonucleotide
agucacauuugauucugaa

SEQ ID NO: 17782 - RNA, 19 nt, Artificial Sequence
  Synthetic oligonucleotide
gucacauuugauucugaaa

SEQ ID NO: 17783 - RNA, 19 nt, Artificial Sequence
  Synthetic oligonucleotide
ucacauuugauucugaaac

SEQ ID NO: 17784 - RNA, 19 nt, Artificial Sequence
  Synthetic oligonucleotide
cacauuugauucugaaaca

SEQ ID NO: 17785 - RNA, 19 nt, Artificial Sequence
  Synthetic oligonucleotide
cauuugauucugaaacagc

SEQ ID NO: 17786 - RNA, 19 nt, Artificial Sequence
  Synthetic oligonucleotide
uugauucugaaacagcagu

SEQ ID NO: 17787 - RNA, 19 nt, Artificial Sequence
  Synthetic oligonucleotide
ugauucugaaacagcaguc

SEQ ID NO: 17788 - RNA, 19 nt, Artificial Sequence
  Synthetic oligonucleotide
gauucugaaacagcaguca

SEQ ID NO: 17789 - RNA, 19 nt, Artificial Sequence
  Synthetic oligonucleotide
auucugaaacagcagucaa

SEQ ID NO: 17790 - RNA, 19 nt, Artificial Sequence
  Synthetic oligonucleotide
uucugaaacagcagucaaa

SEQ ID NO: 17791 - RNA, 19 nt, Artificial Sequence
  Synthetic oligonucleotide
ucugaaacagcagucaaag

SEQ ID NO: 17792 - RNA, 19 nt, Artificial Sequence
  Synthetic oligonucleotide
cugaaacagcagucaaaga

SEQ ID NO: 17793 - RNA, 19 nt, Artificial Sequence
  Synthetic oligonucleotide
ugaaacagcagucaaagaa

SEQ ID NO: 17794 - RNA, 19 nt, Artificial Sequence
  Synthetic oligonucleotide
gaaacagcagucaaagaac

SEQ ID NO: 17795 - RNA, 19 nt, Artificial Sequence
  Synthetic oligonucleotide
aaacagcagucaaagaacu

SEQ ID NO: 17796 - RNA, 19 nt, Artificial Sequence
  Synthetic oligonucleotide
aacagcagucaaagaacug

SEQ ID NO: 17797 - RNA, 19 nt, Artificial Sequence
  Synthetic oligonucleotide
cagcagucaaagaacuguc

SEQ ID NO: 17798 - RNA, 19 nt, Artificial Sequence
  Synthetic oligonucleotide
gcagucaaagaacugucau

SEQ ID NO: 17799 - RNA, 19 nt, Artificial Sequence
  Synthetic oligonucleotide
cagucaaagaacugucaua

SEQ ID NO: 17800 - RNA, 19 nt, Artificial Sequence
  Synthetic oligonucleotide
gucaaagaacugucauacu

SEQ ID NO: 17801 - RNA, 19 nt, Artificial Sequence
  Synthetic oligonucleotide
ucaaagaacugucauacua

SEQ ID NO: 17802 - RNA, 19 nt, Artificial Sequence
  Synthetic oligonucleotide
caaagaacugucauacuac

SEQ ID NO: 17803 - RNA, 19 nt, Artificial Sequence
  Synthetic oligonucleotide
agaacugucauacuacagu

SEQ ID NO: 17804 - RNA, 19 nt, Artificial Sequence
  Synthetic oligonucleotide
aacugucauacuacaguuu

SEQ ID NO: 17805 - RNA, 19 nt, Artificial Sequence
  Synthetic oligonucleotide
acugucauacuacaguuua

SEQ ID NO: 17806 - RNA, 19 nt, Artificial Sequence
  Synthetic oligonucleotide
cugucauacuacaguuuag

SEQ ID NO: 17807 - RNA, 19 nt, Artificial Sequence
  Synthetic oligonucleotide
ugucauacuacaguuuaga

SEQ ID NO: 17808 - RNA, 19 nt, Artificial Sequence
  Synthetic oligonucleotide
gucauacuacaguuuagaa

SEQ ID NO: 17809 - RNA, 19 nt, Artificial Sequence
  Synthetic oligonucleotide
ucauacuacaguuuagaag

SEQ ID NO: 17810 - RNA, 19 nt, Artificial Sequence
  Synthetic oligonucleotide
cauacuacaguuuagaaga

SEQ ID NO: 17811 - RNA, 19 nt, Artificial Sequence
  Synthetic oligonucleotide
auacuacaguuuagaagau

SEQ ID NO: 17812 - RNA, 19 nt, Artificial Sequence
  Synthetic oligonucleotide
uacuacaguuuagaagauu

SEQ ID NO: 17813 - RNA, 19 nt, Artificial Sequence
  Synthetic oligonucleotide
acuacaguuuagaagauuu

SEQ ID NO: 17814 - RNA, 19 nt, Artificial Sequence
  Synthetic oligonucleotide
cuacaguuuagaagauuua

SEQ ID NO: 17815 - RNA, 19 nt, Artificial Sequence
  Synthetic oligonucleotide
uacaguuuagaagauuuaa

SEQ ID NO: 17816 - RNA, 19 nt, Artificial Sequence
  Synthetic oligonucleotide
acaguuuagaagauuuaaa

SEQ ID NO: 17817 - RNA, 19 nt, Artificial Sequence
  Synthetic oligonucleotide
caguuuagaagauuuaaac

SEQ ID NO: 17818 - RNA, 19 nt, Artificial Sequence
  Synthetic oligonucleotide
aguuuagaagauuuaaaca

SEQ ID NO: 17819 - RNA, 19 nt, Artificial Sequence
  Synthetic oligonucleotide
guuuagaagauuuaaacaa

SEQ ID NO: 17820 - RNA, 19 nt, Artificial Sequence
  Synthetic oligonucleotide
uuuagaagauuuaaacaac

SEQ ID NO: 17821 - RNA, 19 nt, Artificial Sequence
  Synthetic oligonucleotide
uuagaagauuuaaacaaca

SEQ ID NO: 17822 - RNA, 19 nt, Artificial Sequence
  Synthetic oligonucleotide
uagaagauuuaaacaacaa

SEQ ID NO: 17823 - RNA, 19 nt, Artificial Sequence
  Synthetic oligonucleotide
agaagauuuaaacaacaag

SEQ ID NO: 17824 - RNA, 19 nt, Artificial Sequence
  Synthetic oligonucleotide
gaagauuuaaacaacaagu

SEQ ID NO: 17825 - RNA, 19 nt, Artificial Sequence
  Synthetic oligonucleotide
aagauuuaaacaacaagua

SEQ ID NO: 17826 - RNA, 19 nt, Artificial Sequence
  Synthetic oligonucleotide
agauuuaaacaacaaguac

SEQ ID NO: 17827 - RNA, 19 nt, Artificial Sequence
  Synthetic oligonucleotide
gauuuaaacaacaaguacc

SEQ ID NO: 17828 - RNA, 19 nt, Artificial Sequence
  Synthetic oligonucleotide
auuuaaacaacaaguaccu

SEQ ID NO: 17829 - RNA, 19 nt, Artificial Sequence
  Synthetic oligonucleotide
guaccuuuauauugcugua

SEQ ID NO: 17830 - RNA, 19 nt, Artificial Sequence
  Synthetic oligonucleotide
accuuuauauugcuguaac

SEQ ID NO: 17831 - RNA, 19 nt, Artificial Sequence
  Synthetic oligonucleotide
ccuuuauauugcuguaaca

SEQ ID NO: 17832 - RNA, 19 nt, Artificial Sequence
  Synthetic oligonucleotide
cuuuauauugcuguaacag

SEQ ID NO: 17833 - RNA, 19 nt, Artificial Sequence
  Synthetic oligonucleotide
uuuauauugcuguaacagu

SEQ ID NO: 17834 - RNA, 19 nt, Artificial Sequence
  Synthetic oligonucleotide
uuauauugcuguaacaguc

SEQ ID NO: 17835 - RNA, 19 nt, Artificial Sequence
  Synthetic oligonucleotide
uauauugcuguaacaguca

SEQ ID NO: 17836 - RNA, 19 nt, Artificial Sequence
  Synthetic oligonucleotide
auauugcuguaacagucau

SEQ ID NO: 17837 - RNA, 19 nt, Artificial Sequence
  Synthetic oligonucleotide
uauugcuguaacagucaua

SEQ ID NO: 17838 - RNA, 19 nt, Artificial Sequence
  Synthetic oligonucleotide
auugcuguaacagucauag

SEQ ID NO: 17839 - RNA, 19 nt, Artificial Sequence
  Synthetic oligonucleotide
uugcuguaacagucauaga

SEQ ID NO: 17840 - RNA, 19 nt, Artificial Sequence
  Synthetic oligonucleotide
ugcuguaacagucauagag

SEQ ID NO: 17841 - RNA, 19 nt, Artificial Sequence
  Synthetic oligonucleotide
gcuguaacagucauagagu

SEQ ID NO: 17842 - RNA, 19 nt, Artificial Sequence
  Synthetic oligonucleotide
cuguaacagucauagaguc

SEQ ID NO: 17843 - RNA, 19 nt, Artificial Sequence
  Synthetic oligonucleotide
uguaacagucauagagucu

SEQ ID NO: 17844 - RNA, 19 nt, Artificial Sequence
  Synthetic oligonucleotide
guaacagucauagagucua

SEQ ID NO: 17845 - RNA, 19 nt, Artificial Sequence
  Synthetic oligonucleotide
uaacagucauagagucuac

SEQ ID NO: 17846 - RNA, 19 nt, Artificial Sequence
  Synthetic oligonucleotide
aacagucauagagucuaca

SEQ ID NO: 17847 - RNA, 19 nt, Artificial Sequence
  Synthetic oligonucleotide
acagucauagagucuacag

SEQ ID NO: 17848 - RNA, 19 nt, Artificial Sequence
  Synthetic oligonucleotide
cagucauagagucuacagg

SEQ ID NO: 17849 - RNA, 19 nt, Artificial Sequence
  Synthetic oligonucleotide
agucauagagucuacaggu

SEQ ID NO: 17850 - RNA, 19 nt, Artificial Sequence
  Synthetic oligonucleotide
gucauagagucuacaggug

SEQ ID NO: 17851 - RNA, 19 nt, Artificial Sequence
  Synthetic oligonucleotide
ucauagagucuacaggugg

SEQ ID NO: 17852 - RNA, 19 nt, Artificial Sequence
  Synthetic oligonucleotide
cauagagucuacaggugga

SEQ ID NO: 17853 - RNA, 19 nt, Artificial Sequence
  Synthetic oligonucleotide
auagagucuacagguggau

SEQ ID NO: 17854 - RNA, 19 nt, Artificial Sequence
  Synthetic oligonucleotide
uagagucuacagguggauu

SEQ ID NO: 17855 - RNA, 19 nt, Artificial Sequence
  Synthetic oligonucleotide
agagucuacagguggauuu

SEQ ID NO: 17856 - RNA, 19 nt, Artificial Sequence
  Synthetic oligonucleotide
gagucuacagguggauuuu

SEQ ID NO: 17857 - RNA, 19 nt, Artificial Sequence
  Synthetic oligonucleotide
agucuacagguggauuuuc

SEQ ID NO: 17858 - RNA, 19 nt, Artificial Sequence
  Synthetic oligonucleotide
gucuacagguggauuuucu

SEQ ID NO: 17859 - RNA, 19 nt, Artificial Sequence
  Synthetic oligonucleotide
ucuacagguggauuuucug

SEQ ID NO: 17860 - RNA, 19 nt, Artificial Sequence
  Synthetic oligonucleotide
cuacagguggauuuucuga

SEQ ID NO: 17861 - RNA, 19 nt, Artificial Sequence
  Synthetic oligonucleotide
uacagguggauuuucugaa

SEQ ID NO: 17862 - RNA, 19 nt, Artificial Sequence
  Synthetic oligonucleotide
acagguggauuuucugaag

SEQ ID NO: 17863 - RNA, 19 nt, Artificial Sequence
  Synthetic oligonucleotide
cagguggauuuucugaaga

SEQ ID NO: 17864 - RNA, 19 nt, Artificial Sequence
  Synthetic oligonucleotide
agguggauuuucugaagag

SEQ ID NO: 17865 - RNA, 19 nt, Artificial Sequence
  Synthetic oligonucleotide
gguggauuuucugaagagg

SEQ ID NO: 17866 - RNA, 19 nt, Artificial Sequence
  Synthetic oligonucleotide
guggauuuucugaagaggc

SEQ ID NO: 17867 - RNA, 19 nt, Artificial Sequence
  Synthetic oligonucleotide
uggauuuucugaagaggca

SEQ ID NO: 17868 - RNA, 19 nt, Artificial Sequence
  Synthetic oligonucleotide
ggauuuucugaagaggcag

SEQ ID NO: 17869 - RNA, 19 nt, Artificial Sequence
  Synthetic oligonucleotide
gauuuucugaagaggcaga

SEQ ID NO: 17870 - RNA, 19 nt, Artificial Sequence
  Synthetic oligonucleotide
auuuucugaagaggcagaa

SEQ ID NO: 17871 - RNA, 19 nt, Artificial Sequence
  Synthetic oligonucleotide
uuuucugaagaggcagaaa

SEQ ID NO: 17872 - RNA, 19 nt, Artificial Sequence
  Synthetic oligonucleotide
uuucugaagaggcagaaau

SEQ ID NO: 17873 - RNA, 19 nt, Artificial Sequence
  Synthetic oligonucleotide
uucugaagaggcagaaaua

SEQ ID NO: 17874 - RNA, 19 nt, Artificial Sequence
  Synthetic oligonucleotide
ucugaagaggcagaaauac

SEQ ID NO: 17875 - RNA, 19 nt, Artificial Sequence
  Synthetic oligonucleotide
cugaagaggcagaaauacc

SEQ ID NO: 17876 - RNA, 19 nt, Artificial Sequence
  Synthetic oligonucleotide
ugaagaggcagaaauaccu

SEQ ID NO: 17877 - RNA, 19 nt, Artificial Sequence
  Synthetic oligonucleotide
gaagaggcagaaauaccug

SEQ ID NO: 17878 - RNA, 19 nt, Artificial Sequence
  Synthetic oligonucleotide
aagaggcagaaauaccugg

SEQ ID NO: 17879 - RNA, 19 nt, Artificial Sequence
  Synthetic oligonucleotide
agaggcagaaauaccuggc

SEQ ID NO: 17880 - RNA, 19 nt, Artificial Sequence
  Synthetic oligonucleotide
gaggcagaaauaccuggca

SEQ ID NO: 17881 - RNA, 19 nt, Artificial Sequence
  Synthetic oligonucleotide
aggcagaaauaccuggcau

SEQ ID NO: 17882 - RNA, 19 nt, Artificial Sequence
  Synthetic oligonucleotide
ggcagaaauaccuggcauc

SEQ ID NO: 17883 - RNA, 19 nt, Artificial Sequence
  Synthetic oligonucleotide
gcagaaauaccuggcauca

SEQ ID NO: 17884 - RNA, 19 nt, Artificial Sequence
  Synthetic oligonucleotide
cagaaauaccuggcaucaa

SEQ ID NO: 17885 - RNA, 19 nt, Artificial Sequence
  Synthetic oligonucleotide
agaaauaccuggcaucaaa

SEQ ID NO: 17886 - RNA, 19 nt, Artificial Sequence
  Synthetic oligonucleotide
gaaauaccuggcaucaaau

SEQ ID NO: 17887 - RNA, 19 nt, Artificial Sequence
  Synthetic oligonucleotide
aaauaccuggcaucaaaua

SEQ ID NO: 17888 - RNA, 19 nt, Artificial Sequence
  Synthetic oligonucleotide
aauaccuggcaucaaauau

SEQ ID NO: 17889 - RNA, 19 nt, Artificial Sequence
  Synthetic oligonucleotide
auaccuggcaucaaauaug

SEQ ID NO: 17890 - RNA, 19 nt, Artificial Sequence
  Synthetic oligonucleotide
uaccuggcaucaaauaugu

SEQ ID NO: 17891 - RNA, 19 nt, Artificial Sequence
  Synthetic oligonucleotide
accuggcaucaaauauguc

SEQ ID NO: 17892 - RNA, 19 nt, Artificial Sequence
  Synthetic oligonucleotide
ccuggcaucaaauaugucc

SEQ ID NO: 17893 - RNA, 19 nt, Artificial Sequence
  Synthetic oligonucleotide
cuggcaucaaauauguccu

SEQ ID NO: 17894 - RNA, 19 nt, Artificial Sequence
  Synthetic oligonucleotide
uggcaucaaauauguccuc

SEQ ID NO: 17895 - RNA, 19 nt, Artificial Sequence
  Synthetic oligonucleotide
ggcaucaaauauguccucu

SEQ ID NO: 17896 - RNA, 19 nt, Artificial Sequence
  Synthetic oligonucleotide
gcaucaaauauguccucuc

SEQ ID NO: 17897 - RNA, 19 nt, Artificial Sequence
  Synthetic oligonucleotide
caucaaauauguccucucu

SEQ ID NO: 17898 - RNA, 19 nt, Artificial Sequence
  Synthetic oligonucleotide
ucaaauauguccucucucc

SEQ ID NO: 17899 - RNA, 19 nt, Artificial Sequence
  Synthetic oligonucleotide
caaauauguccucucuccc

SEQ ID NO: 17900 - RNA, 19 nt, Artificial Sequence
  Synthetic oligonucleotide
aaauauguccucucucccu

SEQ ID NO: 17901 - RNA, 19 nt, Artificial Sequence
  Synthetic oligonucleotide
aauauguccucucucccua

SEQ ID NO: 17902 - RNA, 19 nt, Artificial Sequence
  Synthetic oligonucleotide
auauguccucucucccuac

SEQ ID NO: 17903 - RNA, 19 nt, Artificial Sequence
  Synthetic oligonucleotide
uauguccucucucccuaca

SEQ ID NO: 17904 - RNA, 19 nt, Artificial Sequence
  Synthetic oligonucleotide
auguccucucucccuacaa

SEQ ID NO: 17905 - RNA, 19 nt, Artificial Sequence
  Synthetic oligonucleotide
uguccucucucccuacaaa

SEQ ID NO: 17906 - RNA, 19 nt, Artificial Sequence
  Synthetic oligonucleotide
guccucucucccuacaaac

SEQ ID NO: 17907 - RNA, 19 nt, Artificial Sequence
  Synthetic oligonucleotide
uccucucucccuacaaacu

SEQ ID NO: 17908 - RNA, 19 nt, Artificial Sequence
  Synthetic oligonucleotide
ccucucucccuacaaacug

SEQ ID NO: 17909 - RNA, 19 nt, Artificial Sequence
  Synthetic oligonucleotide
cucucucccuacaaacuga

SEQ ID NO: 17910 - RNA, 19 nt, Artificial Sequence
  Synthetic oligonucleotide
ucucucccuacaaacugaa

SEQ ID NO: 17911 - RNA, 19 nt, Artificial Sequence
  Synthetic oligonucleotide
cucucccuacaaacugaau

SEQ ID NO: 17912 - RNA, 19 nt, Artificial Sequence
  Synthetic oligonucleotide
ucucccuacaaacugaauu

SEQ ID NO: 17913 - RNA, 19 nt, Artificial Sequence
  Synthetic oligonucleotide
cucccuacaaacugaauuu

SEQ ID NO: 17914 - RNA, 19 nt, Artificial Sequence
  Synthetic oligonucleotide
cccuacaaacugaauuugg

SEQ ID NO: 17915 - RNA, 19 nt, Artificial Sequence
  Synthetic oligonucleotide
ccuacaaacugaauuuggu

SEQ ID NO: 17916 - RNA, 19 nt, Artificial Sequence
  Synthetic oligonucleotide
cuacaaacugaauuugguu

SEQ ID NO: 17917 - RNA, 19 nt, Artificial Sequence
  Synthetic oligonucleotide
caaacugaauuugguugcu

SEQ ID NO: 17918 - RNA, 19 nt, Artificial Sequence
  Synthetic oligonucleotide
aaacugaauuugguugcua

SEQ ID NO: 17919 - RNA, 19 nt, Artificial Sequence
  Synthetic oligonucleotide
aacugaauuugguugcuac

SEQ ID NO: 17920 - RNA, 19 nt, Artificial Sequence
  Synthetic oligonucleotide
acugaauuugguugcuacu

SEQ ID NO: 17921 - RNA, 19 nt, Artificial Sequence
  Synthetic oligonucleotide
cugaauuugguugcuacuc

SEQ ID NO: 17922 - RNA, 19 nt, Artificial Sequence
  Synthetic oligonucleotide
ugaauuugguugcuacucc

SEQ ID NO: 17923 - RNA, 19 nt, Artificial Sequence
  Synthetic oligonucleotide
gaauuugguugcuacuccu

SEQ ID NO: 17924 - RNA, 19 nt, Artificial Sequence
  Synthetic oligonucleotide
aauuugguugcuacuccuc

SEQ ID NO: 17925 - RNA, 19 nt, Artificial Sequence
  Synthetic oligonucleotide
auuugguugcuacuccucu

SEQ ID NO: 17926 - RNA, 19 nt, Artificial Sequence
  Synthetic oligonucleotide
uuugguugcuacuccucuu

SEQ ID NO: 17927 - RNA, 19 nt, Artificial Sequence
  Synthetic oligonucleotide
uugguugcuacuccucuuu

SEQ ID NO: 17928 - RNA, 19 nt, Artificial Sequence
  Synthetic oligonucleotide
ugguugcuacuccucuuuu

SEQ ID NO: 17929 - RNA, 19 nt, Artificial Sequence
  Synthetic oligonucleotide
gguugcuacuccucuuuuc

SEQ ID NO: 17930 - RNA, 19 nt, Artificial Sequence
  Synthetic oligonucleotide
guugcuacuccucuuuucc

SEQ ID NO: 17931 - RNA, 19 nt, Artificial Sequence
  Synthetic oligonucleotide
uugcuacuccucuuuuccu

SEQ ID NO: 17932 - RNA, 19 nt, Artificial Sequence
  Synthetic oligonucleotide
ugcuacuccucuuuuccug

SEQ ID NO: 17933 - RNA, 19 nt, Artificial Sequence
  Synthetic oligonucleotide
gcuacuccucuuuuccuga

SEQ ID NO: 17934 - RNA, 19 nt, Artificial Sequence
  Synthetic oligonucleotide
cuacuccucuuuuccugaa

SEQ ID NO: 17935 - RNA, 19 nt, Artificial Sequence
  Synthetic oligonucleotide
uacuccucuuuuccugaag

SEQ ID NO: 17936 - RNA, 19 nt, Artificial Sequence
  Synthetic oligonucleotide
acuccucuuuuccugaagc

SEQ ID NO: 17937 - RNA, 19 nt, Artificial Sequence
  Synthetic oligonucleotide
cuccucuuuuccugaagcc

SEQ ID NO: 17938 - RNA, 19 nt, Artificial Sequence
  Synthetic oligonucleotide
uccucuuuuccugaagccu

SEQ ID NO: 17939 - RNA, 19 nt, Artificial Sequence
  Synthetic oligonucleotide
ccucuuuuccugaagccug

SEQ ID NO: 17940 - RNA, 19 nt, Artificial Sequence
  Synthetic oligonucleotide
cucuuuuccugaagccugg

SEQ ID NO: 17941 - RNA, 19 nt, Artificial Sequence
  Synthetic oligonucleotide
ucuuuuccugaagccuggg

SEQ ID NO: 17942 - RNA, 19 nt, Artificial Sequence
  Synthetic oligonucleotide
cuuuuccugaagccuggga

SEQ ID NO: 17943 - RNA, 19 nt, Artificial Sequence
  Synthetic oligonucleotide
uuuuccugaagccugggau

SEQ ID NO: 17944 - RNA, 19 nt, Artificial Sequence
  Synthetic oligonucleotide
uuuccugaagccugggauu

SEQ ID NO: 17945 - RNA, 19 nt, Artificial Sequence
  Synthetic oligonucleotide
uuccugaagccugggauuc

SEQ ID NO: 17946 - RNA, 19 nt, Artificial Sequence
  Synthetic oligonucleotide
uccugaagccugggauucc

SEQ ID NO: 17947 - RNA, 19 nt, Artificial Sequence
  Synthetic oligonucleotide
ccugaagccugggauucca

SEQ ID NO: 17948 - RNA, 19 nt, Artificial Sequence
  Synthetic oligonucleotide
cugaagccugggauuccau

SEQ ID NO: 17949 - RNA, 19 nt, Artificial Sequence
  Synthetic oligonucleotide
ugaagccugggauuccaua

SEQ ID NO: 17950 - RNA, 19 nt, Artificial Sequence
  Synthetic oligonucleotide
cccaucaaggugcagguua

SEQ ID NO: 17951 - RNA, 19 nt, Artificial Sequence
  Synthetic oligonucleotide
ccaucaaggugcagguuaa

SEQ ID NO: 17952 - RNA, 19 nt, Artificial Sequence
  Synthetic oligonucleotide
caucaaggugcagguuaaa

SEQ ID NO: 17953 - RNA, 19 nt, Artificial Sequence
  Synthetic oligonucleotide
aucaaggugcagguuaaag

SEQ ID NO: 17954 - RNA, 19 nt, Artificial Sequence
  Synthetic oligonucleotide
ucaaggugcagguuaaaga

SEQ ID NO: 17955 - RNA, 19 nt, Artificial Sequence
  Synthetic oligonucleotide
ucgcuugaccaguugguag

SEQ ID NO: 17956 - RNA, 19 nt, Artificial Sequence
  Synthetic oligonucleotide
cgcuugaccaguugguagg

SEQ ID NO: 17957 - RNA, 19 nt, Artificial Sequence
  Synthetic oligonucleotide
gcuugaccaguugguagga

SEQ ID NO: 17958 - RNA, 19 nt, Artificial Sequence
  Synthetic oligonucleotide
cuugaccaguugguaggag

SEQ ID NO: 17959 - RNA, 19 nt, Artificial Sequence
  Synthetic oligonucleotide
agucccaguaacacugaau

SEQ ID NO: 17960 - RNA, 19 nt, Artificial Sequence
  Synthetic oligonucleotide
gucccaguaacacugaaug

SEQ ID NO: 17961 - RNA, 19 nt, Artificial Sequence
  Synthetic oligonucleotide
ucccaguaacacugaaugc

SEQ ID NO: 17962 - RNA, 19 nt, Artificial Sequence
  Synthetic oligonucleotide
cccaguaacacugaaugca

SEQ ID NO: 17963 - RNA, 19 nt, Artificial Sequence
  Synthetic oligonucleotide
ccaguaacacugaaugcac

SEQ ID NO: 17964 - RNA, 19 nt, Artificial Sequence
  Synthetic oligonucleotide
caguaacacugaaugcaca

SEQ ID NO: 17965 - RNA, 19 nt, Artificial Sequence
  Synthetic oligonucleotide
aguaacacugaaugcacaa

SEQ ID NO: 17966 - RNA, 19 nt, Artificial Sequence
  Synthetic oligonucleotide
guaacacugaaugcacaaa

SEQ ID NO: 17967 - RNA, 19 nt, Artificial Sequence
  Synthetic oligonucleotide
uaacacugaaugcacaaac

SEQ ID NO: 17968 - RNA, 19 nt, Artificial Sequence
  Synthetic oligonucleotide
aacacugaaugcacaaaca

SEQ ID NO: 17969 - RNA, 19 nt, Artificial Sequence
  Synthetic oligonucleotide
acacugaaugcacaaacaa

SEQ ID NO: 17970 - RNA, 19 nt, Artificial Sequence
  Synthetic oligonucleotide
cacugaaugcacaaacaau

SEQ ID NO: 17971 - RNA, 19 nt, Artificial Sequence
  Synthetic oligonucleotide
ugaaugcacaaacaauuga

SEQ ID NO: 17972 - RNA, 19 nt, Artificial Sequence
  Synthetic oligonucleotide
gaaugcacaaacaauugau

SEQ ID NO: 17973 - RNA, 19 nt, Artificial Sequence
  Synthetic oligonucleotide
aaugcacaaacaauugaug

SEQ ID NO: 17974 - RNA, 19 nt, Artificial Sequence
  Synthetic oligonucleotide
aaaccaagagacaucugac

SEQ ID NO: 17975 - RNA, 19 nt, Artificial Sequence
  Synthetic oligonucleotide
aaccaagagacaucugacu

SEQ ID NO: 17976 - RNA, 19 nt, Artificial Sequence
  Synthetic oligonucleotide
accaagagacaucugacuu

SEQ ID NO: 17977 - RNA, 19 nt, Artificial Sequence
  Synthetic oligonucleotide
caaaaguguaacacguguu

SEQ ID NO: 17978 - RNA, 19 nt, Artificial Sequence
  Synthetic oligonucleotide
aaaaguguaacacguguug

SEQ ID NO: 17979 - RNA, 19 nt, Artificial Sequence
  Synthetic oligonucleotide
aaaguguaacacguguuga

SEQ ID NO: 17980 - RNA, 19 nt, Artificial Sequence
  Synthetic oligonucleotide
aaguguaacacguguugau

SEQ ID NO: 17981 - RNA, 19 nt, Artificial Sequence
  Synthetic oligonucleotide
aguguaacacguguugaug

SEQ ID NO: 17982 - RNA, 19 nt, Artificial Sequence
  Synthetic oligonucleotide
guguaacacguguugauga

SEQ ID NO: 17983 - RNA, 19 nt, Artificial Sequence
  Synthetic oligonucleotide
uguaacacguguugaugau

SEQ ID NO: 17984 - RNA, 19 nt, Artificial Sequence
  Synthetic oligonucleotide
guaacacguguugaugaug

SEQ ID NO: 17985 - RNA, 19 nt, Artificial Sequence
  Synthetic oligonucleotide
uaacacguguugaugaugg

SEQ ID NO: 17986 - RNA, 19 nt, Artificial Sequence
  Synthetic oligonucleotide
aacacguguugaugaugga

SEQ ID NO: 17987 - RNA, 19 nt, Artificial Sequence
  Synthetic oligonucleotide
acacguguugaugauggag

SEQ ID NO: 17988 - RNA, 19 nt, Artificial Sequence
  Synthetic oligonucleotide
cacguguugaugauggagu

SEQ ID NO: 17989 - RNA, 19 nt, Artificial Sequence
  Synthetic oligonucleotide
acguguugaugauggagua

SEQ ID NO: 17990 - RNA, 19 nt, Artificial Sequence
  Synthetic oligonucleotide
cguguugaugauggaguag

SEQ ID NO: 17991 - RNA, 19 nt, Artificial Sequence
  Synthetic oligonucleotide
guguugaugauggaguagc

SEQ ID NO: 17992 - RNA, 19 nt, Artificial Sequence
  Synthetic oligonucleotide
uguugaugauggaguagcu

SEQ ID NO: 17993 - RNA, 19 nt, Artificial Sequence
  Synthetic oligonucleotide
guugaugauggaguagcuu

SEQ ID NO: 17994 - RNA, 19 nt, Artificial Sequence
  Synthetic oligonucleotide
cuuaaucucccaucuggag

SEQ ID NO: 17995 - RNA, 19 nt, Artificial Sequence
  Synthetic oligonucleotide
uuaaucucccaucuggagu

SEQ ID NO: 17996 - RNA, 19 nt, Artificial Sequence
  Synthetic oligonucleotide
uaaucucccaucuggagug

SEQ ID NO: 17997 - RNA, 19 nt, Artificial Sequence
  Synthetic oligonucleotide
aaucucccaucuggaguga

SEQ ID NO: 17998 - RNA, 19 nt, Artificial Sequence
  Synthetic oligonucleotide
aucucccaucuggagugac

SEQ ID NO: 17999 - RNA, 19 nt, Artificial Sequence
  Synthetic oligonucleotide
cucccaucuggagugacgg

SEQ ID NO: 18000 - RNA, 19 nt, Artificial Sequence
  Synthetic oligonucleotide
cccaucuggagugacggug

SEQ ID NO: 18001 - RNA, 19 nt, Artificial Sequence
  Synthetic oligonucleotide
ccaucuggagugacggugc

SEQ ID NO: 18002 - RNA, 19 nt, Artificial Sequence
  Synthetic oligonucleotide
caucuggagugacggugcu

SEQ ID NO: 18003 - RNA, 19 nt, Artificial Sequence
  Synthetic oligonucleotide
aucuggagugacggugcug

SEQ ID NO: 18004 - RNA, 19 nt, Artificial Sequence
  Synthetic oligonucleotide
ucuggagugacggugcugg

SEQ ID NO: 18005 - RNA, 19 nt, Artificial Sequence
  Synthetic oligonucleotide
cuggagugacggugcugga

SEQ ID NO: 18006 - RNA, 19 nt, Artificial Sequence
  Synthetic oligonucleotide
uggagugacggugcuggag

SEQ ID NO: 18007 - RNA, 19 nt, Artificial Sequence
  Synthetic oligonucleotide
ggagugacggugcuggagu

SEQ ID NO: 18008 - RNA, 19 nt, Artificial Sequence
  Synthetic oligonucleotide
gagugacggugcuggaguu

SEQ ID NO: 18009 - RNA, 19 nt, Artificial Sequence
  Synthetic oligonucleotide
agugacggugcuggaguuu

SEQ ID NO: 18010 - RNA, 19 nt, Artificial Sequence
  Synthetic oligonucleotide
gugacggugcuggaguuua

SEQ ID NO: 18011 - RNA, 19 nt, Artificial Sequence
  Synthetic oligonucleotide
ugacggugcuggaguuuaa

SEQ ID NO: 18012 - RNA, 19 nt, Artificial Sequence
  Synthetic oligonucleotide
gacggugcuggaguuuaau

SEQ ID NO: 18013 - RNA, 19 nt, Artificial Sequence
  Synthetic oligonucleotide
acggugcuggaguuuaaug

SEQ ID NO: 18014 - RNA, 19 nt, Artificial Sequence
  Synthetic oligonucleotide
cggugcuggaguuuaaugu

SEQ ID NO: 18015 - RNA, 19 nt, Artificial Sequence
  Synthetic oligonucleotide
ggugcuggaguuuaauguc

SEQ ID NO: 18016 - RNA, 19 nt, Artificial Sequence
  Synthetic oligonucleotide
gugcuggaguuuaauguca

SEQ ID NO: 18017 - RNA, 19 nt, Artificial Sequence
  Synthetic oligonucleotide
ugcuggaguuuaaugucaa

SEQ ID NO: 18018 - RNA, 19 nt, Artificial Sequence
  Synthetic oligonucleotide
gcuggaguuuaaugucaaa

SEQ ID NO: 18019 - RNA, 19 nt, Artificial Sequence
  Synthetic oligonucleotide
cuggaguuuaaugucaaaa

SEQ ID NO: 18020 - RNA, 19 nt, Artificial Sequence
  Synthetic oligonucleotide
uggaguuuaaugucaaaac

SEQ ID NO: 18021 - RNA, 19 nt, Artificial Sequence
  Synthetic oligonucleotide
ggaguuuaaugucaaaacu

SEQ ID NO: 18022 - RNA, 19 nt, Artificial Sequence
  Synthetic oligonucleotide
gaguuuaaugucaaaacug

SEQ ID NO: 18023 - RNA, 19 nt, Artificial Sequence
  Synthetic oligonucleotide
aguuuaaugucaaaacuga

SEQ ID NO: 18024 - RNA, 19 nt, Artificial Sequence
  Synthetic oligonucleotide
guuuaaugucaaaacugau

SEQ ID NO: 18025 - RNA, 19 nt, Artificial Sequence
  Synthetic oligonucleotide
uuuaaugucaaaacugaug

SEQ ID NO: 18026 - RNA, 19 nt, Artificial Sequence
  Synthetic oligonucleotide
uuaaugucaaaacugaugc

SEQ ID NO: 18027 - RNA, 19 nt, Artificial Sequence
  Synthetic oligonucleotide
uaaugucaaaacugaugcu

SEQ ID NO: 18028 - RNA, 19 nt, Artificial Sequence
  Synthetic oligonucleotide
aaugucaaaacugaugcuc

SEQ ID NO: 18029 - RNA, 19 nt, Artificial Sequence
  Synthetic oligonucleotide
augucaaaacugaugcucc

SEQ ID NO: 18030 - RNA, 19 nt, Artificial Sequence
  Synthetic oligonucleotide
ugucaaaacugaugcucca

SEQ ID NO: 18031 - RNA, 19 nt, Artificial Sequence
  Synthetic oligonucleotide
gucaaaacugaugcuccag

SEQ ID NO: 18032 - RNA, 19 nt, Artificial Sequence
  Synthetic oligonucleotide
ucaaaacugaugcuccaga

SEQ ID NO: 18033 - RNA, 19 nt, Artificial Sequence
  Synthetic oligonucleotide
caaaacugaugcuccagau

SEQ ID NO: 18034 - RNA, 19 nt, Artificial Sequence
  Synthetic oligonucleotide
aaaacugaugcuccagauc

SEQ ID NO: 18035 - RNA, 19 nt, Artificial Sequence
  Synthetic oligonucleotide
aaacugaugcuccagaucu

SEQ ID NO: 18036 - RNA, 19 nt, Artificial Sequence
  Synthetic oligonucleotide
aacugaugcuccagaucuu

SEQ ID NO: 18037 - RNA, 19 nt, Artificial Sequence
  Synthetic oligonucleotide
acugaugcuccagaucuuc

SEQ ID NO: 18038 - RNA, 19 nt, Artificial Sequence
  Synthetic oligonucleotide
cugaugcuccagaucuucc

SEQ ID NO: 18039 - RNA, 19 nt, Artificial Sequence
  Synthetic oligonucleotide
ugaugcuccagaucuucca

SEQ ID NO: 18040 - RNA, 19 nt, Artificial Sequence
  Synthetic oligonucleotide
gaugcuccagaucuuccag

SEQ ID NO: 18041 - RNA, 19 nt, Artificial Sequence
  Synthetic oligonucleotide
agaaaaucaggccagggaa

SEQ ID NO: 18042 - RNA, 19 nt, Artificial Sequence
  Synthetic oligonucleotide
gaaaaucaggccagggaag

SEQ ID NO: 18043 - RNA, 19 nt, Artificial Sequence
  Synthetic oligonucleotide
aaaaucaggccagggaagg

SEQ ID NO: 18044 - RNA, 19 nt, Artificial Sequence
  Synthetic oligonucleotide
aaaucaggccagggaaggu

SEQ ID NO: 18045 - RNA, 19 nt, Artificial Sequence
  Synthetic oligonucleotide
aaucaggccagggaagguu

SEQ ID NO: 18046 - RNA, 19 nt, Artificial Sequence
  Synthetic oligonucleotide
aucaggccagggaagguua

SEQ ID NO: 18047 - RNA, 19 nt, Artificial Sequence
  Synthetic oligonucleotide
ucaggccagggaagguuac

SEQ ID NO: 18048 - RNA, 19 nt, Artificial Sequence
  Synthetic oligonucleotide
caggccagggaagguuacc

SEQ ID NO: 18049 - RNA, 19 nt, Artificial Sequence
  Synthetic oligonucleotide
aggccagggaagguuaccg

SEQ ID NO: 18050 - RNA, 19 nt, Artificial Sequence
  Synthetic oligonucleotide
ggccagggaagguuaccga

SEQ ID NO: 18051 - RNA, 19 nt, Artificial Sequence
  Synthetic oligonucleotide
gccagggaagguuaccgag

SEQ ID NO: 18052 - RNA, 19 nt, Artificial Sequence
  Synthetic oligonucleotide
ccagggaagguuaccgagc

SEQ ID NO: 18053 - RNA, 19 nt, Artificial Sequence
  Synthetic oligonucleotide
cagggaagguuaccgagca

SEQ ID NO: 18054 - RNA, 19 nt, Artificial Sequence
  Synthetic oligonucleotide
agggaagguuaccgagcaa

SEQ ID NO: 18055 - RNA, 19 nt, Artificial Sequence
  Synthetic oligonucleotide
gggaagguuaccgagcaau

SEQ ID NO: 18056 - RNA, 19 nt, Artificial Sequence
  Synthetic oligonucleotide
ggaagguuaccgagcaaua

SEQ ID NO: 18057 - RNA, 19 nt, Artificial Sequence
  Synthetic oligonucleotide
gaagguuaccgagcaauag

SEQ ID NO: 18058 - RNA, 19 nt, Artificial Sequence
  Synthetic oligonucleotide
aagguuaccgagcaauagc

SEQ ID NO: 18059 - RNA, 19 nt, Artificial Sequence
  Synthetic oligonucleotide
gguuaccgagcaauagcau

SEQ ID NO: 18060 - RNA, 19 nt, Artificial Sequence
  Synthetic oligonucleotide
guuaccgagcaauagcaua

SEQ ID NO: 18061 - RNA, 19 nt, Artificial Sequence
  Synthetic oligonucleotide
uuaccgagcaauagcauac

SEQ ID NO: 18062 - RNA, 19 nt, Artificial Sequence
  Synthetic oligonucleotide
uaccgagcaauagcauacu

SEQ ID NO: 18063 - RNA, 19 nt, Artificial Sequence
  Synthetic oligonucleotide
accgagcaauagcauacuc

SEQ ID NO: 18064 - RNA, 19 nt, Artificial Sequence
  Synthetic oligonucleotide
ccgagcaauagcauacuca

SEQ ID NO: 18065 - RNA, 19 nt, Artificial Sequence
  Synthetic oligonucleotide
cgagcaauagcauacucau

SEQ ID NO: 18066 - RNA, 19 nt, Artificial Sequence
  Synthetic oligonucleotide
gagcaauagcauacucauc

SEQ ID NO: 18067 - RNA, 19 nt, Artificial Sequence
  Synthetic oligonucleotide
agcaauagcauacucaucu

SEQ ID NO: 18068 - RNA, 19 nt, Artificial Sequence
  Synthetic oligonucleotide
gcaauagcauacucaucuc

SEQ ID NO: 18069 - RNA, 19 nt, Artificial Sequence
  Synthetic oligonucleotide
caauagcauacucaucucu

SEQ ID NO: 18070 - RNA, 19 nt, Artificial Sequence
  Synthetic oligonucleotide
aauagcauacucaucucuc

SEQ ID NO: 18071 - RNA, 19 nt, Artificial Sequence
  Synthetic oligonucleotide
auagcauacucaucucuca

SEQ ID NO: 18072 - RNA, 19 nt, Artificial Sequence
  Synthetic oligonucleotide
uagcauacucaucucucag

SEQ ID NO: 18073 - RNA, 19 nt, Artificial Sequence
  Synthetic oligonucleotide
agcauacucaucucucagc

SEQ ID NO: 18074 - RNA, 19 nt, Artificial Sequence
  Synthetic oligonucleotide
gcauacucaucucucagcc

SEQ ID NO: 18075 - RNA, 19 nt, Artificial Sequence
  Synthetic oligonucleotide
cauacucaucucucagcca

SEQ ID NO: 18076 - RNA, 19 nt, Artificial Sequence
  Synthetic oligonucleotide
auacucaucucucagccaa

SEQ ID NO: 18077 - RNA, 19 nt, Artificial Sequence
  Synthetic oligonucleotide
uacucaucucucagccaaa

SEQ ID NO: 18078 - RNA, 19 nt, Artificial Sequence
  Synthetic oligonucleotide
acucaucucucagccaaag

SEQ ID NO: 18079 - RNA, 19 nt, Artificial Sequence
  Synthetic oligonucleotide
cucaucucucagccaaagu

SEQ ID NO: 18080 - RNA, 19 nt, Artificial Sequence
  Synthetic oligonucleotide
ucaucucucagccaaaguu

SEQ ID NO: 18081 - RNA, 19 nt, Artificial Sequence
  Synthetic oligonucleotide
caucucucagccaaaguua

SEQ ID NO: 18082 - RNA, 19 nt, Artificial Sequence
  Synthetic oligonucleotide
aucucucagccaaaguuac

SEQ ID NO: 18083 - RNA, 19 nt, Artificial Sequence
  Synthetic oligonucleotide
ucucucagccaaaguuacc

SEQ ID NO: 18084 - RNA, 19 nt, Artificial Sequence
  Synthetic oligonucleotide
cucucagccaaaguuaccu

SEQ ID NO: 18085 - RNA, 19 nt, Artificial Sequence
  Synthetic oligonucleotide
ucucagccaaaguuaccuu

SEQ ID NO: 18086 - RNA, 19 nt, Artificial Sequence
  Synthetic oligonucleotide
uaaggcuuugcuaguggga

SEQ ID NO: 18087 - RNA, 19 nt, Artificial Sequence
  Synthetic oligonucleotide
aaggcuuugcuagugggag

SEQ ID NO: 18088 - RNA, 19 nt, Artificial Sequence
  Synthetic oligonucleotide
aggcuuugcuagugggaga

SEQ ID NO: 18089 - RNA, 19 nt, Artificial Sequence
  Synthetic oligonucleotide
cccaaaagcccauauauug

SEQ ID NO: 18090 - RNA, 19 nt, Artificial Sequence
  Synthetic oligonucleotide
ccaaaagcccauauauuga

SEQ ID NO: 18091 - RNA, 19 nt, Artificial Sequence
  Synthetic oligonucleotide
aaaagcccauauauugaca

SEQ ID NO: 18092 - RNA, 19 nt, Artificial Sequence
  Synthetic oligonucleotide
aaagcccauauauugacaa

SEQ ID NO: 18093 - RNA, 19 nt, Artificial Sequence
  Synthetic oligonucleotide
aagcccauauauugacaaa

SEQ ID NO: 18094 - RNA, 19 nt, Artificial Sequence
  Synthetic oligonucleotide
cccauauauugacaaaaua

SEQ ID NO: 18095 - RNA, 19 nt, Artificial Sequence
  Synthetic oligonucleotide
uauauugacaaaauaacuc

SEQ ID NO: 18096 - RNA, 19 nt, Artificial Sequence
  Synthetic oligonucleotide
auauugacaaaauaacuca

SEQ ID NO: 18097 - RNA, 19 nt, Artificial Sequence
  Synthetic oligonucleotide
auugacaaaauaacucacu

SEQ ID NO: 18098 - RNA, 19 nt, Artificial Sequence
  Synthetic oligonucleotide
uuacuugauuuuauccaag

SEQ ID NO: 18099 - RNA, 19 nt, Artificial Sequence
  Synthetic oligonucleotide
uacuugauuuuauccaagg

SEQ ID NO: 18100 - RNA, 19 nt, Artificial Sequence
  Synthetic oligonucleotide
acuugauuuuauccaaggg

SEQ ID NO: 18101 - RNA, 19 nt, Artificial Sequence
  Synthetic oligonucleotide
cuugauuuuauccaagggc

SEQ ID NO: 18102 - RNA, 19 nt, Artificial Sequence
  Synthetic oligonucleotide
uugauuuuauccaagggca

SEQ ID NO: 18103 - RNA, 19 nt, Artificial Sequence
  Synthetic oligonucleotide
ugauuuuauccaagggcaa

SEQ ID NO: 18104 - RNA, 19 nt, Artificial Sequence
  Synthetic oligonucleotide
gauuuuauccaagggcaaa

SEQ ID NO: 18105 - RNA, 19 nt, Artificial Sequence
  Synthetic oligonucleotide
auuuuauccaagggcaaaa

SEQ ID NO: 18106 - RNA, 19 nt, Artificial Sequence
  Synthetic oligonucleotide
uuuuauccaagggcaaaau

SEQ ID NO: 18107 - RNA, 19 nt, Artificial Sequence
  Synthetic oligonucleotide
uuuauccaagggcaaaauu

SEQ ID NO: 18108 - RNA, 19 nt, Artificial Sequence
  Synthetic oligonucleotide
uuauccaagggcaaaauua

SEQ ID NO: 18109 - RNA, 19 nt, Artificial Sequence
  Synthetic oligonucleotide
uauccaagggcaaaauuau

SEQ ID NO: 18110 - RNA, 19 nt, Artificial Sequence
  Synthetic oligonucleotide
auccaagggcaaaauuauc

SEQ ID NO: 18111 - RNA, 19 nt, Artificial Sequence
  Synthetic oligonucleotide
uccaagggcaaaauuaucc

SEQ ID NO: 18112 - RNA, 19 nt, Artificial Sequence
  Synthetic oligonucleotide
ccaagggcaaaauuaucca

SEQ ID NO: 18113 - RNA, 19 nt, Artificial Sequence
  Synthetic oligonucleotide
caagggcaaaauuauccac

SEQ ID NO: 18114 - RNA, 19 nt, Artificial Sequence
  Synthetic oligonucleotide
aagggcaaaauuauccacu

SEQ ID NO: 18115 - RNA, 19 nt, Artificial Sequence
  Synthetic oligonucleotide
agggcaaaauuauccacuu

SEQ ID NO: 18116 - RNA, 19 nt, Artificial Sequence
  Synthetic oligonucleotide
gggcaaaauuauccacuuu

SEQ ID NO: 18117 - RNA, 19 nt, Artificial Sequence
  Synthetic oligonucleotide
ggcaaaauuauccacuuug

SEQ ID NO: 18118 - RNA, 19 nt, Artificial Sequence
  Synthetic oligonucleotide
gcaaaauuauccacuuugg

SEQ ID NO: 18119 - RNA, 19 nt, Artificial Sequence
  Synthetic oligonucleotide
caaaauuauccacuuuggc

SEQ ID NO: 18120 - RNA, 19 nt, Artificial Sequence
  Synthetic oligonucleotide
aaaauuauccacuuuggca

SEQ ID NO: 18121 - RNA, 19 nt, Artificial Sequence
  Synthetic oligonucleotide
uuuucagaugcaucuuauc

SEQ ID NO: 18122 - RNA, 19 nt, Artificial Sequence
  Synthetic oligonucleotide
uuucagaugcaucuuauca

SEQ ID NO: 18123 - RNA, 19 nt, Artificial Sequence
  Synthetic oligonucleotide
uucagaugcaucuuaucaa

SEQ ID NO: 18124 - RNA, 19 nt, Artificial Sequence
  Synthetic oligonucleotide
ucagaugcaucuuaucaaa

SEQ ID NO: 18125 - RNA, 19 nt, Artificial Sequence
  Synthetic oligonucleotide
cagaugcaucuuaucaaag

SEQ ID NO: 18126 - RNA, 19 nt, Artificial Sequence
  Synthetic oligonucleotide
agaugcaucuuaucaaagu

SEQ ID NO: 18127 - RNA, 19 nt, Artificial Sequence
  Synthetic oligonucleotide
gaugcaucuuaucaaagua

SEQ ID NO: 18128 - RNA, 19 nt, Artificial Sequence
  Synthetic oligonucleotide
augcaucuuaucaaaguau

SEQ ID NO: 18129 - RNA, 19 nt, Artificial Sequence
  Synthetic oligonucleotide
ugcaucuuaucaaaguaua

SEQ ID NO: 18130 - RNA, 19 nt, Artificial Sequence
  Synthetic oligonucleotide
gcaucuuaucaaaguauaa

SEQ ID NO: 18131 - RNA, 19 nt, Artificial Sequence
  Synthetic oligonucleotide
caucuuaucaaaguauaaa

SEQ ID NO: 18132 - RNA, 19 nt, Artificial Sequence
  Synthetic oligonucleotide
aucuuaucaaaguauaaac

SEQ ID NO: 18133 - RNA, 19 nt, Artificial Sequence
  Synthetic oligonucleotide
ucuuaucaaaguauaaaca

SEQ ID NO: 18134 - RNA, 19 nt, Artificial Sequence
  Synthetic oligonucleotide
cuuaucaaaguauaaacau

SEQ ID NO: 18135 - RNA, 19 nt, Artificial Sequence
  Synthetic oligonucleotide
uuaucaaaguauaaacauu

SEQ ID NO: 18136 - RNA, 19 nt, Artificial Sequence
  Synthetic oligonucleotide
uaucaaaguauaaacauuc

SEQ ID NO: 18137 - RNA, 19 nt, Artificial Sequence
  Synthetic oligonucleotide
aucaaaguauaaacauucc

SEQ ID NO: 18138 - RNA, 19 nt, Artificial Sequence
  Synthetic oligonucleotide
ucaaaguauaaacauucca

SEQ ID NO: 18139 - RNA, 19 nt, Artificial Sequence
  Synthetic oligonucleotide
acagaacaugguuccuuca

SEQ ID NO: 18140 - RNA, 19 nt, Artificial Sequence
  Synthetic oligonucleotide
cagaacaugguuccuucau

SEQ ID NO: 18141 - RNA, 19 nt, Artificial Sequence
  Synthetic oligonucleotide
agaacaugguuccuucauc

SEQ ID NO: 18142 - RNA, 19 nt, Artificial Sequence
  Synthetic oligonucleotide
gaacaugguuccuucaucc

SEQ ID NO: 18143 - RNA, 19 nt, Artificial Sequence
  Synthetic oligonucleotide
aacaugguuccuucauccc

SEQ ID NO: 18144 - RNA, 19 nt, Artificial Sequence
  Synthetic oligonucleotide
acaugguuccuucaucccg

SEQ ID NO: 18145 - RNA, 19 nt, Artificial Sequence
  Synthetic oligonucleotide
caugguuccuucaucccga

SEQ ID NO: 18146 - RNA, 19 nt, Artificial Sequence
  Synthetic oligonucleotide
augguuccuucaucccgac

SEQ ID NO: 18147 - RNA, 19 nt, Artificial Sequence
  Synthetic oligonucleotide
ucuggucuauuacaucguc

SEQ ID NO: 18148 - RNA, 19 nt, Artificial Sequence
  Synthetic oligonucleotide
cuggucuauuacaucguca

SEQ ID NO: 18149 - RNA, 19 nt, Artificial Sequence
  Synthetic oligonucleotide
uggucuauuacaucgucac

SEQ ID NO: 18150 - RNA, 19 nt, Artificial Sequence
  Synthetic oligonucleotide
ggucuauuacaucgucaca

SEQ ID NO: 18151 - RNA, 19 nt, Artificial Sequence
  Synthetic oligonucleotide
gucuauuacaucgucacag

SEQ ID NO: 18152 - RNA, 19 nt, Artificial Sequence
  Synthetic oligonucleotide
ucuauuacaucgucacagg

SEQ ID NO: 18153 - RNA, 19 nt, Artificial Sequence
  Synthetic oligonucleotide
cuauuacaucgucacagga

SEQ ID NO: 18154 - RNA, 19 nt, Artificial Sequence
  Synthetic oligonucleotide
uauuacaucgucacaggag

SEQ ID NO: 18155 - RNA, 19 nt, Artificial Sequence
  Synthetic oligonucleotide
acagacagcagaauuagug

SEQ ID NO: 18156 - RNA, 19 nt, Artificial Sequence
  Synthetic oligonucleotide
cagacagcagaauuagugu

SEQ ID NO: 18157 - RNA, 19 nt, Artificial Sequence
  Synthetic oligonucleotide
agacagcagaauuaguguc

SEQ ID NO: 18158 - RNA, 19 nt, Artificial Sequence
  Synthetic oligonucleotide
gacagcagaauuagugucu

SEQ ID NO: 18159 - RNA, 19 nt, Artificial Sequence
  Synthetic oligonucleotide
acagcagaauuagugucug

SEQ ID NO: 18160 - RNA, 19 nt, Artificial Sequence
  Synthetic oligonucleotide
cagcagaauuagugucuga

SEQ ID NO: 18161 - RNA, 19 nt, Artificial Sequence
  Synthetic oligonucleotide
agcagaauuagugucugau

SEQ ID NO: 18162 - RNA, 19 nt, Artificial Sequence
  Synthetic oligonucleotide
gcagaauuagugucugauu

SEQ ID NO: 18163 - RNA, 19 nt, Artificial Sequence
  Synthetic oligonucleotide
cagaauuagugucugauuc

SEQ ID NO: 18164 - RNA, 19 nt, Artificial Sequence
  Synthetic oligonucleotide
agaauuagugucugauuca

SEQ ID NO: 18165 - RNA, 19 nt, Artificial Sequence
  Synthetic oligonucleotide
gaauuagugucugauucag

SEQ ID NO: 18166 - RNA, 19 nt, Artificial Sequence
  Synthetic oligonucleotide
aauuagugucugauucagu

SEQ ID NO: 18167 - RNA, 19 nt, Artificial Sequence
  Synthetic oligonucleotide
auuagugucugauucaguc

SEQ ID NO: 18168 - RNA, 19 nt, Artificial Sequence
  Synthetic oligonucleotide
uuagugucugauucagucu

SEQ ID NO: 18169 - RNA, 19 nt, Artificial Sequence
  Synthetic oligonucleotide
uagugucugauucagucug

SEQ ID NO: 18170 - RNA, 19 nt, Artificial Sequence
  Synthetic oligonucleotide
agugucugauucagucugg

SEQ ID NO: 18171 - RNA, 19 nt, Artificial Sequence
  Synthetic oligonucleotide
gugucugauucagucuggu

SEQ ID NO: 18172 - RNA, 19 nt, Artificial Sequence
  Synthetic oligonucleotide
gucugauucagucugguua

SEQ ID NO: 18173 - RNA, 19 nt, Artificial Sequence
  Synthetic oligonucleotide
auucagucugguuaaauau

SEQ ID NO: 18174 - RNA, 19 nt, Artificial Sequence
  Synthetic oligonucleotide
gguuaaauauugaagaaaa

SEQ ID NO: 18175 - RNA, 19 nt, Artificial Sequence
  Synthetic oligonucleotide
guuaaauauugaagaaaaa

SEQ ID NO: 18176 - RNA, 19 nt, Artificial Sequence
  Synthetic oligonucleotide
uuaaauauugaagaaaaau

SEQ ID NO: 18177 - RNA, 19 nt, Artificial Sequence
  Synthetic oligonucleotide
uaaauauugaagaaaaaug

SEQ ID NO: 18178 - RNA, 19 nt, Artificial Sequence
  Synthetic oligonucleotide
aaauauugaagaaaaaugu

SEQ ID NO: 18179 - RNA, 19 nt, Artificial Sequence
  Synthetic oligonucleotide
aauauugaagaaaaaugug

SEQ ID NO: 18180 - RNA, 19 nt, Artificial Sequence
  Synthetic oligonucleotide
auauugaagaaaaaugugg

SEQ ID NO: 18181 - RNA, 19 nt, Artificial Sequence
  Synthetic oligonucleotide
uauugaagaaaaauguggc

SEQ ID NO: 18182 - RNA, 19 nt, Artificial Sequence
  Synthetic oligonucleotide
auugaagaaaaauguggca

SEQ ID NO: 18183 - RNA, 19 nt, Artificial Sequence
  Synthetic oligonucleotide
uugaagaaaaauguggcaa

SEQ ID NO: 18184 - RNA, 19 nt, Artificial Sequence
  Synthetic oligonucleotide
ugaagaaaaauguggcaac

SEQ ID NO: 18185 - RNA, 19 nt, Artificial Sequence
  Synthetic oligonucleotide
gaagaaaaauguggcaacc

SEQ ID NO: 18186 - RNA, 19 nt, Artificial Sequence
  Synthetic oligonucleotide
aagaaaaauguggcaacca

SEQ ID NO: 18187 - RNA, 19 nt, Artificial Sequence
  Synthetic oligonucleotide
agaaaaauguggcaaccag

SEQ ID NO: 18188 - RNA, 19 nt, Artificial Sequence
  Synthetic oligonucleotide
gaaaaauguggcaaccagc

SEQ ID NO: 18189 - RNA, 19 nt, Artificial Sequence
  Synthetic oligonucleotide
aaaaauguggcaaccagcu

SEQ ID NO: 18190 - RNA, 19 nt, Artificial Sequence
  Synthetic oligonucleotide
aaaauguggcaaccagcuc

SEQ ID NO: 18191 - RNA, 19 nt, Artificial Sequence
  Synthetic oligonucleotide
aaauguggcaaccagcucc

SEQ ID NO: 18192 - RNA, 19 nt, Artificial Sequence
  Synthetic oligonucleotide
aauguggcaaccagcucca

SEQ ID NO: 18193 - RNA, 19 nt, Artificial Sequence
  Synthetic oligonucleotide
guggcaaccagcuccaggu

SEQ ID NO: 18194 - RNA, 19 nt, Artificial Sequence
  Synthetic oligonucleotide
uggcaaccagcuccagguu

SEQ ID NO: 18195 - RNA, 19 nt, Artificial Sequence
  Synthetic oligonucleotide
ggcaaccagcuccagguuc

SEQ ID NO: 18196 - RNA, 19 nt, Artificial Sequence
  Synthetic oligonucleotide
gcaaccagcuccagguuca

SEQ ID NO: 18197 - RNA, 19 nt, Artificial Sequence
  Synthetic oligonucleotide
caaccagcuccagguucau

SEQ ID NO: 18198 - RNA, 19 nt, Artificial Sequence
  Synthetic oligonucleotide
aaccagcuccagguucauc

SEQ ID NO: 18199 - RNA, 19 nt, Artificial Sequence
  Synthetic oligonucleotide
accagcuccagguucaucu

SEQ ID NO: 18200 - RNA, 19 nt, Artificial Sequence
  Synthetic oligonucleotide
ccagcuccagguucaucug

SEQ ID NO: 18201 - RNA, 19 nt, Artificial Sequence
  Synthetic oligonucleotide
cagcuccagguucaucugu

SEQ ID NO: 18202 - RNA, 19 nt, Artificial Sequence
  Synthetic oligonucleotide
agcuccagguucaucuguc

SEQ ID NO: 18203 - RNA, 19 nt, Artificial Sequence
  Synthetic oligonucleotide
gcuccagguucaucugucu

SEQ ID NO: 18204 - RNA, 19 nt, Artificial Sequence
  Synthetic oligonucleotide
cuccagguucaucugucuc

SEQ ID NO: 18205 - RNA, 19 nt, Artificial Sequence
  Synthetic oligonucleotide
uccagguucaucugucucc

SEQ ID NO: 18206 - RNA, 19 nt, Artificial Sequence
  Synthetic oligonucleotide
ccagguucaucugucuccu

SEQ ID NO: 18207 - RNA, 19 nt, Artificial Sequence
  Synthetic oligonucleotide
cagguucaucugucuccug

SEQ ID NO: 18208 - RNA, 19 nt, Artificial Sequence
  Synthetic oligonucleotide
agguucaucugucuccuga

SEQ ID NO: 18209 - RNA, 19 nt, Artificial Sequence
  Synthetic oligonucleotide
gguucaucugucuccugau

SEQ ID NO: 18210 - RNA, 19 nt, Artificial Sequence
  Synthetic oligonucleotide
guucaucugucuccugaug

SEQ ID NO: 18211 - RNA, 19 nt, Artificial Sequence
  Synthetic oligonucleotide
uucaucugucuccugaugc

SEQ ID NO: 18212 - RNA, 19 nt, Artificial Sequence
  Synthetic oligonucleotide
ucaucugucuccugaugca

SEQ ID NO: 18213 - RNA, 19 nt, Artificial Sequence
  Synthetic oligonucleotide
caucugucuccugaugcag

SEQ ID NO: 18214 - RNA, 19 nt, Artificial Sequence
  Synthetic oligonucleotide
aucugucuccugaugcaga

SEQ ID NO: 18215 - RNA, 19 nt, Artificial Sequence
  Synthetic oligonucleotide
aauggauuccuggguggca

SEQ ID NO: 18216 - RNA, 19 nt, Artificial Sequence
  Synthetic oligonucleotide
auggauuccuggguggcau

SEQ ID NO: 18217 - RNA, 19 nt, Artificial Sequence
  Synthetic oligonucleotide
uggauuccuggguggcauu

SEQ ID NO: 18218 - RNA, 19 nt, Artificial Sequence
  Synthetic oligonucleotide
ggagccaaaaagcccuugg

SEQ ID NO: 18219 - RNA, 19 nt, Artificial Sequence
  Synthetic oligonucleotide
gagccaaaaagcccuugga

SEQ ID NO: 18220 - RNA, 19 nt, Artificial Sequence
  Synthetic oligonucleotide
agccaaaaagcccuuggaa

SEQ ID NO: 18221 - RNA, 19 nt, Artificial Sequence
  Synthetic oligonucleotide
gccaaaaagcccuuggaaa

SEQ ID NO: 18222 - RNA, 19 nt, Artificial Sequence
  Synthetic oligonucleotide
ccaaaaagcccuuggaaag

SEQ ID NO: 18223 - RNA, 19 nt, Artificial Sequence
  Synthetic oligonucleotide
caaaaagcccuuggaaaga

SEQ ID NO: 18224 - RNA, 19 nt, Artificial Sequence
  Synthetic oligonucleotide
aaaaagcccuuggaaagag

SEQ ID NO: 18225 - RNA, 19 nt, Artificial Sequence
  Synthetic oligonucleotide
aaaagcccuuggaaagagu

SEQ ID NO: 18226 - RNA, 19 nt, Artificial Sequence
  Synthetic oligonucleotide
aaagcccuuggaaagagua

SEQ ID NO: 18227 - RNA, 19 nt, Artificial Sequence
  Synthetic oligonucleotide
aagcccuuggaaagaguau

SEQ ID NO: 18228 - RNA, 19 nt, Artificial Sequence
  Synthetic oligonucleotide
agcccuuggaaagaguauu

SEQ ID NO: 18229 - RNA, 19 nt, Artificial Sequence
  Synthetic oligonucleotide
gcccuuggaaagaguauuu

SEQ ID NO: 18230 - RNA, 19 nt, Artificial Sequence
  Synthetic oligonucleotide
cccuuggaaagaguauuuc

SEQ ID NO: 18231 - RNA, 19 nt, Artificial Sequence
  Synthetic oligonucleotide
ccuuggaaagaguauuuca

SEQ ID NO: 18232 - RNA, 19 nt, Artificial Sequence
  Synthetic oligonucleotide
cuuggaaagaguauuucaa

SEQ ID NO: 18233 - RNA, 19 nt, Artificial Sequence
  Synthetic oligonucleotide
uuggaaagaguauuucaau

SEQ ID NO: 18234 - RNA, 19 nt, Artificial Sequence
  Synthetic oligonucleotide
uggaaagaguauuucaauu

SEQ ID NO: 18235 - RNA, 19 nt, Artificial Sequence
  Synthetic oligonucleotide
ggaaagaguauuucaauuc

SEQ ID NO: 18236 - RNA, 19 nt, Artificial Sequence
  Synthetic oligonucleotide
gaaagaguauuucaauucu

SEQ ID NO: 18237 - RNA, 19 nt, Artificial Sequence
  Synthetic oligonucleotide
aaagaguauuucaauucuu

SEQ ID NO: 18238 - RNA, 19 nt, Artificial Sequence
  Synthetic oligonucleotide
aagaguauuucaauucuua

SEQ ID NO: 18239 - RNA, 19 nt, Artificial Sequence
  Synthetic oligonucleotide
agaguauuucaauucuuag

SEQ ID NO: 18240 - RNA, 19 nt, Artificial Sequence
  Synthetic oligonucleotide
gaguauuucaauucuuaga

SEQ ID NO: 18241 - RNA, 19 nt, Artificial Sequence
  Synthetic oligonucleotide
aguauuucaauucuuagag

SEQ ID NO: 18242 - RNA, 19 nt, Artificial Sequence
  Synthetic oligonucleotide
guauuucaauucuuagaga

SEQ ID NO: 18243 - RNA, 19 nt, Artificial Sequence
  Synthetic oligonucleotide
uauuucaauucuuagagaa

SEQ ID NO: 18244 - RNA, 19 nt, Artificial Sequence
  Synthetic oligonucleotide
auuucaauucuuagagaag

SEQ ID NO: 18245 - RNA, 19 nt, Artificial Sequence
  Synthetic oligonucleotide
uuucaauucuuagagaaga

SEQ ID NO: 18246 - RNA, 19 nt, Artificial Sequence
  Synthetic oligonucleotide
uucaauucuuagagaagag

SEQ ID NO: 18247 - RNA, 19 nt, Artificial Sequence
  Synthetic oligonucleotide
ucaauucuuagagaagagu

SEQ ID NO: 18248 - RNA, 19 nt, Artificial Sequence
  Synthetic oligonucleotide
caauucuuagagaagagug

SEQ ID NO: 18249 - RNA, 19 nt, Artificial Sequence
  Synthetic oligonucleotide
aauucuuagagaagaguga

SEQ ID NO: 18250 - RNA, 19 nt, Artificial Sequence
  Synthetic oligonucleotide
auucuuagagaagagugau

SEQ ID NO: 18251 - RNA, 19 nt, Artificial Sequence
  Synthetic oligonucleotide
ucuuagagaagagugaucu

SEQ ID NO: 18252 - RNA, 19 nt, Artificial Sequence
  Synthetic oligonucleotide
cuuagagaagagugaucug

SEQ ID NO: 18253 - RNA, 19 nt, Artificial Sequence
  Synthetic oligonucleotide
uagagaagagugaucuggg

SEQ ID NO: 18254 - RNA, 19 nt, Artificial Sequence
  Synthetic oligonucleotide
guggggcaggugguggccu

SEQ ID NO: 18255 - RNA, 19 nt, Artificial Sequence
  Synthetic oligonucleotide
ggcaggugguggccucaac

SEQ ID NO: 18256 - RNA, 19 nt, Artificial Sequence
  Synthetic oligonucleotide
gcaggugguggccucaaca

SEQ ID NO: 18257 - RNA, 19 nt, Artificial Sequence
  Synthetic oligonucleotide
caggugguggccucaacaa

SEQ ID NO: 18258 - RNA, 19 nt, Artificial Sequence
  Synthetic oligonucleotide
aggugguggccucaacaau

SEQ ID NO: 18259 - RNA, 19 nt, Artificial Sequence
  Synthetic oligonucleotide
ggugguggccucaacaaug

SEQ ID NO: 18260 - RNA, 19 nt, Artificial Sequence
  Synthetic oligonucleotide
gugguggccucaacaaugc

SEQ ID NO: 18261 - RNA, 19 nt, Artificial Sequence
  Synthetic oligonucleotide
uguuccaccuagcuggacu

SEQ ID NO: 18262 - RNA, 19 nt, Artificial Sequence
  Synthetic oligonucleotide
guuccaccuagcuggacuu

SEQ ID NO: 18263 - RNA, 19 nt, Artificial Sequence
  Synthetic oligonucleotide
uuccaccuagcuggacuua

SEQ ID NO: 18264 - RNA, 19 nt, Artificial Sequence
  Synthetic oligonucleotide
uccaccuagcuggacuuac

SEQ ID NO: 18265 - RNA, 19 nt, Artificial Sequence
  Synthetic oligonucleotide
ccaccuagcuggacuuacc

SEQ ID NO: 18266 - RNA, 19 nt, Artificial Sequence
  Synthetic oligonucleotide
caccuagcuggacuuaccu

SEQ ID NO: 18267 - RNA, 19 nt, Artificial Sequence
  Synthetic oligonucleotide
accuagcuggacuuaccuu

SEQ ID NO: 18268 - RNA, 19 nt, Artificial Sequence
  Synthetic oligonucleotide
ccuagcuggacuuaccuuc

SEQ ID NO: 18269 - RNA, 19 nt, Artificial Sequence
  Synthetic oligonucleotide
cuagcuggacuuaccuucc

SEQ ID NO: 18270 - RNA, 19 nt, Artificial Sequence
  Synthetic oligonucleotide
uagcuggacuuaccuuccu

SEQ ID NO: 18271 - RNA, 19 nt, Artificial Sequence
  Synthetic oligonucleotide
agcuggacuuaccuuccuc

SEQ ID NO: 18272 - RNA, 19 nt, Artificial Sequence
  Synthetic oligonucleotide
gcuggacuuaccuuccuca

SEQ ID NO: 18273 - RNA, 19 nt, Artificial Sequence
  Synthetic oligonucleotide
cuggacuuaccuuccucac

SEQ ID NO: 18274 - RNA, 19 nt, Artificial Sequence
  Synthetic oligonucleotide
uggacuuaccuuccucacu

SEQ ID NO: 18275 - RNA, 19 nt, Artificial Sequence
  Synthetic oligonucleotide
ggacuuaccuuccucacua

SEQ ID NO: 18276 - RNA, 19 nt, Artificial Sequence
  Synthetic oligonucleotide
gacuuaccuuccucacuaa

SEQ ID NO: 18277 - RNA, 19 nt, Artificial Sequence
  Synthetic oligonucleotide
acuuaccuuccucacuaau

SEQ ID NO: 18278 - RNA, 19 nt, Artificial Sequence
  Synthetic oligonucleotide
cuuaccuuccucacuaaug

SEQ ID NO: 18279 - RNA, 19 nt, Artificial Sequence
  Synthetic oligonucleotide
uuaccuuccucacuaaugc

SEQ ID NO: 18280 - RNA, 19 nt, Artificial Sequence
  Synthetic oligonucleotide
uaccuuccucacuaaugca

SEQ ID NO: 18281 - RNA, 19 nt, Artificial Sequence
  Synthetic oligonucleotide
accuuccucacuaaugcaa

SEQ ID NO: 18282 - RNA, 19 nt, Artificial Sequence
  Synthetic oligonucleotide
ccuuccucacuaaugcaaa

SEQ ID NO: 18283 - RNA, 19 nt, Artificial Sequence
  Synthetic oligonucleotide
cuuccucacuaaugcaaau

SEQ ID NO: 18284 - RNA, 19 nt, Artificial Sequence
  Synthetic oligonucleotide
uuccucacuaaugcaaaug

SEQ ID NO: 18285 - RNA, 19 nt, Artificial Sequence
  Synthetic oligonucleotide
uccucacuaaugcaaaugc

SEQ ID NO: 18286 - RNA, 19 nt, Artificial Sequence
  Synthetic oligonucleotide
ccucacuaaugcaaaugca

SEQ ID NO: 18287 - RNA, 19 nt, Artificial Sequence
  Synthetic oligonucleotide
cucacuaaugcaaaugcag

SEQ ID NO: 18288 - RNA, 19 nt, Artificial Sequence
  Synthetic oligonucleotide
ucacuaaugcaaaugcaga

SEQ ID NO: 18289 - RNA, 19 nt, Artificial Sequence
  Synthetic oligonucleotide
cacuaaugcaaaugcagau

SEQ ID NO: 18290 - RNA, 19 nt, Artificial Sequence
  Synthetic oligonucleotide
acuaaugcaaaugcagaug

SEQ ID NO: 18291 - RNA, 19 nt, Artificial Sequence
  Synthetic oligonucleotide
cuaaugcaaaugcagauga

SEQ ID NO: 18292 - RNA, 19 nt, Artificial Sequence
  Synthetic oligonucleotide
uaaugcaaaugcagaugac

SEQ ID NO: 18293 - RNA, 19 nt, Artificial Sequence
  Synthetic oligonucleotide
aaugcaaaugcagaugacu

SEQ ID NO: 18294 - RNA, 19 nt, Artificial Sequence
  Synthetic oligonucleotide
augcaaaugcagaugacuc

SEQ ID NO: 18295 - RNA, 19 nt, Artificial Sequence
  Synthetic oligonucleotide
ugcaaaugcagaugacucc

SEQ ID NO: 18296 - RNA, 19 nt, Artificial Sequence
  Synthetic oligonucleotide
gcaaaugcagaugacuccc

SEQ ID NO: 18297 - RNA, 19 nt, Artificial Sequence
  Synthetic oligonucleotide
caaaugcagaugacuccca

SEQ ID NO: 18298 - RNA, 19 nt, Artificial Sequence
  Synthetic oligonucleotide
aaaugcagaugacucccaa

SEQ ID NO: 18299 - RNA, 19 nt, Artificial Sequence
  Synthetic oligonucleotide
aaugcagaugacucccaag

SEQ ID NO: 18300 - RNA, 19 nt, Artificial Sequence
  Synthetic oligonucleotide
augcagaugacucccaaga

SEQ ID NO: 18301 - RNA, 19 nt, Artificial Sequence
  Synthetic oligonucleotide
ugcagaugacucccaagaa

SEQ ID NO: 18302 - RNA, 19 nt, Artificial Sequence
  Synthetic oligonucleotide
gcagaugacucccaagaaa

SEQ ID NO: 18303 - RNA, 19 nt, Artificial Sequence
  Synthetic oligonucleotide
cagaugacucccaagaaaa

SEQ ID NO: 18304 - RNA, 19 nt, Artificial Sequence
  Synthetic oligonucleotide
agaugacucccaagaaaau

SEQ ID NO: 18305 - RNA, 19 nt, Artificial Sequence
  Synthetic oligonucleotide
gaugacucccaagaaaaug

SEQ ID NO: 18306 - RNA, 19 nt, Artificial Sequence
  Synthetic oligonucleotide
augacucccaagaaaauga

SEQ ID NO: 18307 - RNA, 19 nt, Artificial Sequence
  Synthetic oligonucleotide
ugacucccaagaaaaugau

SEQ ID NO: 18308 - RNA, 19 nt, Artificial Sequence
  Synthetic oligonucleotide
gacucccaagaaaaugaug

SEQ ID NO: 18309 - RNA, 19 nt, Artificial Sequence
  Synthetic oligonucleotide
acucccaagaaaaugauga

SEQ ID NO: 18310 - RNA, 19 nt, Artificial Sequence
  Synthetic oligonucleotide
cucccaagaaaaugaugaa

SEQ ID NO: 18311 - RNA, 19 nt, Artificial Sequence
  Synthetic oligonucleotide
ucccaagaaaaugaugaac

SEQ ID NO: 18312 - RNA, 19 nt, Artificial Sequence
  Synthetic oligonucleotide
cccaagaaaaugaugaacc

SEQ ID NO: 18313 - RNA, 19 nt, Artificial Sequence
  Synthetic oligonucleotide
ccaagaaaaugaugaaccu

SEQ ID NO: 18314 - RNA, 19 nt, Artificial Sequence
  Synthetic oligonucleotide
caagaaaaugaugaaccuu

SEQ ID NO: 18315 - RNA, 19 nt, Artificial Sequence
  Synthetic oligonucleotide
agaaaaugaugaaccuugu

SEQ ID NO: 18316 - RNA, 19 nt, Artificial Sequence
  Synthetic oligonucleotide
gaaaaugaugaaccuugua

SEQ ID NO: 18317 - RNA, 19 nt, Artificial Sequence
  Synthetic oligonucleotide
aaaaugaugaaccuuguaa

SEQ ID NO: 18318 - RNA, 19 nt, Artificial Sequence
  Synthetic oligonucleotide
aaaugaugaaccuuguaaa

SEQ ID NO: 18319 - RNA, 19 nt, Artificial Sequence
  Synthetic oligonucleotide
augaugaaccuuguaaaga

SEQ ID NO: 18320 - RNA, 19 nt, Artificial Sequence
  Synthetic oligonucleotide
augaaccuuguaaagaaau

SEQ ID NO: 18321 - RNA, 19 nt, Artificial Sequence
  Synthetic oligonucleotide
aagaagauagaagaaauag

SEQ ID NO: 18322 - RNA, 19 nt, Artificial Sequence
  Synthetic oligonucleotide
agaagauagaagaaauagc

SEQ ID NO: 18323 - RNA, 19 nt, Artificial Sequence
  Synthetic oligonucleotide
gaagauagaagaaauagcu

SEQ ID NO: 18324 - RNA, 19 nt, Artificial Sequence
  Synthetic oligonucleotide
aagauagaagaaauagcug

SEQ ID NO: 18325 - RNA, 19 nt, Artificial Sequence
  Synthetic oligonucleotide
agauagaagaaauagcugc

SEQ ID NO: 18326 - RNA, 19 nt, Artificial Sequence
  Synthetic oligonucleotide
gauagaagaaauagcugcu

SEQ ID NO: 18327 - RNA, 19 nt, Artificial Sequence
  Synthetic oligonucleotide
auagaagaaauagcugcua

SEQ ID NO: 18328 - RNA, 19 nt, Artificial Sequence
  Synthetic oligonucleotide
uagaagaaauagcugcuaa

SEQ ID NO: 18329 - RNA, 19 nt, Artificial Sequence
  Synthetic oligonucleotide
agaagaaauagcugcuaaa

SEQ ID NO: 18330 - RNA, 19 nt, Artificial Sequence
  Synthetic oligonucleotide
gaagaaauagcugcuaaau

SEQ ID NO: 18331 - RNA, 19 nt, Artificial Sequence
  Synthetic oligonucleotide
aagaaauagcugcuaaaua

SEQ ID NO: 18332 - RNA, 19 nt, Artificial Sequence
  Synthetic oligonucleotide
agaaauagcugcuaaauau

SEQ ID NO: 18333 - RNA, 19 nt, Artificial Sequence
  Synthetic oligonucleotide
gaaauagcugcuaaauaua

SEQ ID NO: 18334 - RNA, 19 nt, Artificial Sequence
  Synthetic oligonucleotide
aaauagcugcuaaauauaa

SEQ ID NO: 18335 - RNA, 19 nt, Artificial Sequence
  Synthetic oligonucleotide
aauagcugcuaaauauaaa

SEQ ID NO: 18336 - RNA, 19 nt, Artificial Sequence
  Synthetic oligonucleotide
auagcugcuaaauauaaac

SEQ ID NO: 18337 - RNA, 19 nt, Artificial Sequence
  Synthetic oligonucleotide
uagcugcuaaauauaaaca

SEQ ID NO: 18338 - RNA, 19 nt, Artificial Sequence
  Synthetic oligonucleotide
agcugcuaaauauaaacau

SEQ ID NO: 18339 - RNA, 19 nt, Artificial Sequence
  Synthetic oligonucleotide
guagugaagaaauguuguu

SEQ ID NO: 18340 - RNA, 19 nt, Artificial Sequence
  Synthetic oligonucleotide
uagugaagaaauguuguua

SEQ ID NO: 18341 - RNA, 19 nt, Artificial Sequence
  Synthetic oligonucleotide
agugaagaaauguuguuac

SEQ ID NO: 18342 - RNA, 19 nt, Artificial Sequence
  Synthetic oligonucleotide
gugaagaaauguuguuacg

SEQ ID NO: 18343 - RNA, 19 nt, Artificial Sequence
  Synthetic oligonucleotide
ugaagaaauguuguuacga

SEQ ID NO: 18344 - RNA, 19 nt, Artificial Sequence
  Synthetic oligonucleotide
gaagaaauguuguuacgau

SEQ ID NO: 18345 - RNA, 19 nt, Artificial Sequence
  Synthetic oligonucleotide
aagaaauguuguuacgaug

SEQ ID NO: 18346 - RNA, 19 nt, Artificial Sequence
  Synthetic oligonucleotide
agaaauguuguuacgaugg

SEQ ID NO: 18347 - RNA, 19 nt, Artificial Sequence
  Synthetic oligonucleotide
gaaauguuguuacgaugga

SEQ ID NO: 18348 - RNA, 19 nt, Artificial Sequence
  Synthetic oligonucleotide
aaugaugaaaccugugagc

SEQ ID NO: 18349 - RNA, 19 nt, Artificial Sequence
  Synthetic oligonucleotide
augaugaaaccugugagca

SEQ ID NO: 18350 - RNA, 19 nt, Artificial Sequence
  Synthetic oligonucleotide
ugaugaaaccugugagcag

SEQ ID NO: 18351 - RNA, 19 nt, Artificial Sequence
  Synthetic oligonucleotide
gaugaaaccugugagcagc

SEQ ID NO: 18352 - RNA, 19 nt, Artificial Sequence
  Synthetic oligonucleotide
augaaaccugugagcagcg

SEQ ID NO: 18353 - RNA, 19 nt, Artificial Sequence
  Synthetic oligonucleotide
ugaaaccugugagcagcga

SEQ ID NO: 18354 - RNA, 19 nt, Artificial Sequence
  Synthetic oligonucleotide
gaaaccugugagcagcgag

SEQ ID NO: 18355 - RNA, 19 nt, Artificial Sequence
  Synthetic oligonucleotide
accugugagcagcgagcug

SEQ ID NO: 18356 - RNA, 19 nt, Artificial Sequence
  Synthetic oligonucleotide
ccugugagcagcgagcugc

SEQ ID NO: 18357 - RNA, 19 nt, Artificial Sequence
  Synthetic oligonucleotide
cugugagcagcgagcugca

SEQ ID NO: 18358 - RNA, 19 nt, Artificial Sequence
  Synthetic oligonucleotide
ugugagcagcgagcugcac

SEQ ID NO: 18359 - RNA, 19 nt, Artificial Sequence
  Synthetic oligonucleotide
gugagcagcgagcugcacg

SEQ ID NO: 18360 - RNA, 19 nt, Artificial Sequence
  Synthetic oligonucleotide
ugagcagcgagcugcacgg

SEQ ID NO: 18361 - RNA, 19 nt, Artificial Sequence
  Synthetic oligonucleotide
gagcagcgagcugcacgga

SEQ ID NO: 18362 - RNA, 19 nt, Artificial Sequence
  Synthetic oligonucleotide
agcagcgagcugcacggau

SEQ ID NO: 18363 - RNA, 19 nt, Artificial Sequence
  Synthetic oligonucleotide
gcagcgagcugcacggauu

SEQ ID NO: 18364 - RNA, 19 nt, Artificial Sequence
  Synthetic oligonucleotide
cagcgagcugcacggauua

SEQ ID NO: 18365 - RNA, 19 nt, Artificial Sequence
  Synthetic oligonucleotide
agcgagcugcacggauuag

SEQ ID NO: 18366 - RNA, 19 nt, Artificial Sequence
  Synthetic oligonucleotide
ugucgucgcaagccagcuc

SEQ ID NO: 18367 - RNA, 19 nt, Artificial Sequence
  Synthetic oligonucleotide
gucgucgcaagccagcucc

SEQ ID NO: 18368 - RNA, 19 nt, Artificial Sequence
  Synthetic oligonucleotide
ucgucgcaagccagcuccg

SEQ ID NO: 18369 - RNA, 19 nt, Artificial Sequence
  Synthetic oligonucleotide
cgucgcaagccagcuccgu

SEQ ID NO: 18370 - RNA, 19 nt, Artificial Sequence
  Synthetic oligonucleotide
gucgcaagccagcuccgug

SEQ ID NO: 18371 - RNA, 19 nt, Artificial Sequence
  Synthetic oligonucleotide
ucgcaagccagcuccgugc

SEQ ID NO: 18372 - RNA, 19 nt, Artificial Sequence
  Synthetic oligonucleotide
cgcaagccagcuccgugcu

SEQ ID NO: 18373 - RNA, 19 nt, Artificial Sequence
  Synthetic oligonucleotide
gcaagccagcuccgugcua

SEQ ID NO: 18374 - RNA, 19 nt, Artificial Sequence
  Synthetic oligonucleotide
caagccagcuccgugcuaa

SEQ ID NO: 18375 - RNA, 19 nt, Artificial Sequence
  Synthetic oligonucleotide
aagccagcuccgugcuaau

SEQ ID NO: 18376 - RNA, 19 nt, Artificial Sequence
  Synthetic oligonucleotide
acaugaagacccuguuacc

SEQ ID NO: 18377 - RNA, 19 nt, Artificial Sequence
  Synthetic oligonucleotide
caugaagacccuguuacca

SEQ ID NO: 18378 - RNA, 19 nt, Artificial Sequence
  Synthetic oligonucleotide
augaagacccuguuaccag

SEQ ID NO: 18379 - RNA, 19 nt, Artificial Sequence
  Synthetic oligonucleotide
gaagacccuguuaccagua

SEQ ID NO: 18380 - RNA, 19 nt, Artificial Sequence
  Synthetic oligonucleotide
aagacccuguuaccaguaa

SEQ ID NO: 18381 - RNA, 19 nt, Artificial Sequence
  Synthetic oligonucleotide
agacccuguuaccaguaag

SEQ ID NO: 18382 - RNA, 19 nt, Artificial Sequence
  Synthetic oligonucleotide
gacccuguuaccaguaagc

SEQ ID NO: 18383 - RNA, 19 nt, Artificial Sequence
  Synthetic oligonucleotide
acccuguuaccaguaagca

SEQ ID NO: 18384 - RNA, 19 nt, Artificial Sequence
  Synthetic oligonucleotide
cccuguuaccaguaagcaa

SEQ ID NO: 18385 - RNA, 19 nt, Artificial Sequence
  Synthetic oligonucleotide
ccuguuaccaguaagcaag

SEQ ID NO: 18386 - RNA, 19 nt, Artificial Sequence
  Synthetic oligonucleotide
cuguuaccaguaagcaagc

SEQ ID NO: 18387 - RNA, 19 nt, Artificial Sequence
  Synthetic oligonucleotide
uguuaccaguaagcaagcc

SEQ ID NO: 18388 - RNA, 19 nt, Artificial Sequence
  Synthetic oligonucleotide
guuaccaguaagcaagcca

SEQ ID NO: 18389 - RNA, 19 nt, Artificial Sequence
  Synthetic oligonucleotide
uuaccaguaagcaagccag

SEQ ID NO: 18390 - RNA, 19 nt, Artificial Sequence
  Synthetic oligonucleotide
uaccaguaagcaagccaga

SEQ ID NO: 18391 - RNA, 19 nt, Artificial Sequence
  Synthetic oligonucleotide
accaguaagcaagccagaa

SEQ ID NO: 18392 - RNA, 19 nt, Artificial Sequence
  Synthetic oligonucleotide
ccaguaagcaagccagaaa

SEQ ID NO: 18393 - RNA, 19 nt, Artificial Sequence
  Synthetic oligonucleotide
caguaagcaagccagaaau

SEQ ID NO: 18394 - RNA, 19 nt, Artificial Sequence
  Synthetic oligonucleotide
aguaagcaagccagaaauu

SEQ ID NO: 18395 - RNA, 19 nt, Artificial Sequence
  Synthetic oligonucleotide
guaagcaagccagaaauuc

SEQ ID NO: 18396 - RNA, 19 nt, Artificial Sequence
  Synthetic oligonucleotide
uaagcaagccagaaauucg

SEQ ID NO: 18397 - RNA, 19 nt, Artificial Sequence
  Synthetic oligonucleotide
aagcaagccagaaauucgg

SEQ ID NO: 18398 - RNA, 19 nt, Artificial Sequence
  Synthetic oligonucleotide
agcaagccagaaauucgga

SEQ ID NO: 18399 - RNA, 19 nt, Artificial Sequence
  Synthetic oligonucleotide
caagccagaaauucggagu

SEQ ID NO: 18400 - RNA, 19 nt, Artificial Sequence
  Synthetic oligonucleotide
aagccagaaauucggaguu

SEQ ID NO: 18401 - RNA, 19 nt, Artificial Sequence
  Synthetic oligonucleotide
agccagaaauucggaguua

SEQ ID NO: 18402 - RNA, 19 nt, Artificial Sequence
  Synthetic oligonucleotide
gccagaaauucggaguuau

SEQ ID NO: 18403 - RNA, 19 nt, Artificial Sequence
  Synthetic oligonucleotide
ccagaaauucggaguuauu

SEQ ID NO: 18404 - RNA, 19 nt, Artificial Sequence
  Synthetic oligonucleotide
cagaaauucggaguuauuu

SEQ ID NO: 18405 - RNA, 19 nt, Artificial Sequence
  Synthetic oligonucleotide
agaaauucggaguuauuuu

SEQ ID NO: 18406 - RNA, 19 nt, Artificial Sequence
  Synthetic oligonucleotide
gaaauucggaguuauuuuc

SEQ ID NO: 18407 - RNA, 19 nt, Artificial Sequence
  Synthetic oligonucleotide
aaauucggaguuauuuucc

SEQ ID NO: 18408 - RNA, 19 nt, Artificial Sequence
  Synthetic oligonucleotide
aauucggaguuauuuucca

SEQ ID NO: 18409 - RNA, 19 nt, Artificial Sequence
  Synthetic oligonucleotide
auucggaguuauuuuccag

SEQ ID NO: 18410 - RNA, 19 nt, Artificial Sequence
  Synthetic oligonucleotide
uucggaguuauuuuccaga

SEQ ID NO: 18411 - RNA, 19 nt, Artificial Sequence
  Synthetic oligonucleotide
ucggaguuauuuuccagaa

SEQ ID NO: 18412 - RNA, 19 nt, Artificial Sequence
  Synthetic oligonucleotide
cggaguuauuuuccagaaa

SEQ ID NO: 18413 - RNA, 19 nt, Artificial Sequence
  Synthetic oligonucleotide
ggaguuauuuuccagaaag

SEQ ID NO: 18414 - RNA, 19 nt, Artificial Sequence
  Synthetic oligonucleotide
gaguuauuuuccagaaagc

SEQ ID NO: 18415 - RNA, 19 nt, Artificial Sequence
  Synthetic oligonucleotide
aguuauuuuccagaaagcu

SEQ ID NO: 18416 - RNA, 19 nt, Artificial Sequence
  Synthetic oligonucleotide
guuauuuuccagaaagcug

SEQ ID NO: 18417 - RNA, 19 nt, Artificial Sequence
  Synthetic oligonucleotide
uuauuuuccagaaagcugg

SEQ ID NO: 18418 - RNA, 19 nt, Artificial Sequence
  Synthetic oligonucleotide
uauuuuccagaaagcuggu

SEQ ID NO: 18419 - RNA, 19 nt, Artificial Sequence
  Synthetic oligonucleotide
gugggaaguucaucuuguu

SEQ ID NO: 18420 - RNA, 19 nt, Artificial Sequence
  Synthetic oligonucleotide
ugggaaguucaucuuguuc

SEQ ID NO: 18421 - RNA, 19 nt, Artificial Sequence
  Synthetic oligonucleotide
gggaaguucaucuuguucc

SEQ ID NO: 18422 - RNA, 19 nt, Artificial Sequence
  Synthetic oligonucleotide
ggaaguucaucuuguuccc

SEQ ID NO: 18423 - RNA, 19 nt, Artificial Sequence
  Synthetic oligonucleotide
gaaguucaucuuguuccca

SEQ ID NO: 18424 - RNA, 19 nt, Artificial Sequence
  Synthetic oligonucleotide
aaguucaucuuguucccag

SEQ ID NO: 18425 - RNA, 19 nt, Artificial Sequence
  Synthetic oligonucleotide
aguucaucuuguucccaga

SEQ ID NO: 18426 - RNA, 19 nt, Artificial Sequence
  Synthetic oligonucleotide
guucaucuuguucccagaa

SEQ ID NO: 18427 - RNA, 19 nt, Artificial Sequence
  Synthetic oligonucleotide
uucaucuuguucccagaag

SEQ ID NO: 18428 - RNA, 19 nt, Artificial Sequence
  Synthetic oligonucleotide
ucaucuuguucccagaaga

SEQ ID NO: 18429 - RNA, 19 nt, Artificial Sequence
  Synthetic oligonucleotide
caucuuguucccagaagaa

SEQ ID NO: 18430 - RNA, 19 nt, Artificial Sequence
  Synthetic oligonucleotide
aucuuguucccagaagaaa

SEQ ID NO: 18431 - RNA, 19 nt, Artificial Sequence
  Synthetic oligonucleotide
ucuuguucccagaagaaaa

SEQ ID NO: 18432 - RNA, 19 nt, Artificial Sequence
  Synthetic oligonucleotide
cuuguucccagaagaaaac

SEQ ID NO: 18433 - RNA, 19 nt, Artificial Sequence
  Synthetic oligonucleotide
uuguucccagaagaaaaca

SEQ ID NO: 18434 - RNA, 19 nt, Artificial Sequence
  Synthetic oligonucleotide
uguucccagaagaaaacag

SEQ ID NO: 18435 - RNA, 19 nt, Artificial Sequence
  Synthetic oligonucleotide
guucccagaagaaaacagu

SEQ ID NO: 18436 - RNA, 19 nt, Artificial Sequence
  Synthetic oligonucleotide
uucccagaagaaaacaguu

SEQ ID NO: 18437 - RNA, 19 nt, Artificial Sequence
  Synthetic oligonucleotide
ucccagaagaaaacaguug

SEQ ID NO: 18438 - RNA, 19 nt, Artificial Sequence
  Synthetic oligonucleotide
cccagaagaaaacaguugc

SEQ ID NO: 18439 - RNA, 19 nt, Artificial Sequence
  Synthetic oligonucleotide
ccagaagaaaacaguugca

SEQ ID NO: 18440 - RNA, 19 nt, Artificial Sequence
  Synthetic oligonucleotide
cagaagaaaacaguugcag

SEQ ID NO: 18441 - RNA, 19 nt, Artificial Sequence
  Synthetic oligonucleotide
agaagaaaacaguugcagu

SEQ ID NO: 18442 - RNA, 19 nt, Artificial Sequence
  Synthetic oligonucleotide
gaagaaaacaguugcaguu

SEQ ID NO: 18443 - RNA, 19 nt, Artificial Sequence
  Synthetic oligonucleotide
aagaaaacaguugcaguuu

SEQ ID NO: 18444 - RNA, 19 nt, Artificial Sequence
  Synthetic oligonucleotide
agaaaacaguugcaguuug

SEQ ID NO: 18445 - RNA, 19 nt, Artificial Sequence
  Synthetic oligonucleotide
gaaaacaguugcaguuugc

SEQ ID NO: 18446 - RNA, 19 nt, Artificial Sequence
  Synthetic oligonucleotide
aaaacaguugcaguuugcc

SEQ ID NO: 18447 - RNA, 19 nt, Artificial Sequence
  Synthetic oligonucleotide
aaacaguugcaguuugccc

SEQ ID NO: 18448 - RNA, 19 nt, Artificial Sequence
  Synthetic oligonucleotide
aacaguugcaguuugcccu

SEQ ID NO: 18449 - RNA, 19 nt, Artificial Sequence
  Synthetic oligonucleotide
acaguugcaguuugcccua

SEQ ID NO: 18450 - RNA, 19 nt, Artificial Sequence
  Synthetic oligonucleotide
caguugcaguuugcccuac

SEQ ID NO: 18451 - RNA, 19 nt, Artificial Sequence
  Synthetic oligonucleotide
aguugcaguuugcccuacc

SEQ ID NO: 18452 - RNA, 19 nt, Artificial Sequence
  Synthetic oligonucleotide
guugcaguuugcccuaccu

SEQ ID NO: 18453 - RNA, 19 nt, Artificial Sequence
  Synthetic oligonucleotide
uugcaguuugcccuaccug

SEQ ID NO: 18454 - RNA, 19 nt, Artificial Sequence
  Synthetic oligonucleotide
ugcaguuugcccuaccuga

SEQ ID NO: 18455 - RNA, 19 nt, Artificial Sequence
  Synthetic oligonucleotide
gcaguuugcccuaccugau

SEQ ID NO: 18456 - RNA, 19 nt, Artificial Sequence
  Synthetic oligonucleotide
caguuugcccuaccugauu

SEQ ID NO: 18457 - RNA, 19 nt, Artificial Sequence
  Synthetic oligonucleotide
aguuugcccuaccugauuc

SEQ ID NO: 18458 - RNA, 19 nt, Artificial Sequence
  Synthetic oligonucleotide
aggcaaagguguucaaaga

SEQ ID NO: 18459 - RNA, 19 nt, Artificial Sequence
  Synthetic oligonucleotide
ggcaaagguguucaaagau

SEQ ID NO: 18460 - RNA, 19 nt, Artificial Sequence
  Synthetic oligonucleotide
gcaaagguguucaaagaug

SEQ ID NO: 18461 - RNA, 19 nt, Artificial Sequence
  Synthetic oligonucleotide
caaagguguucaaagaugu

SEQ ID NO: 18462 - RNA, 19 nt, Artificial Sequence
  Synthetic oligonucleotide
aaagguguucaaagauguc

SEQ ID NO: 18463 - RNA, 19 nt, Artificial Sequence
  Synthetic oligonucleotide
aagguguucaaagaugucu

SEQ ID NO: 18464 - RNA, 19 nt, Artificial Sequence
  Synthetic oligonucleotide
agguguucaaagaugucuu

SEQ ID NO: 18465 - RNA, 19 nt, Artificial Sequence
  Synthetic oligonucleotide
gguguucaaagaugucuuc

SEQ ID NO: 18466 - RNA, 19 nt, Artificial Sequence
  Synthetic oligonucleotide
guguucaaagaugucuucc

SEQ ID NO: 18467 - RNA, 19 nt, Artificial Sequence
  Synthetic oligonucleotide
uguucaaagaugucuuccu

SEQ ID NO: 18468 - RNA, 19 nt, Artificial Sequence
  Synthetic oligonucleotide
guucaaagaugucuuccug

SEQ ID NO: 18469 - RNA, 19 nt, Artificial Sequence
  Synthetic oligonucleotide
uucaaagaugucuuccugg

SEQ ID NO: 18470 - RNA, 19 nt, Artificial Sequence
  Synthetic oligonucleotide
ucaaagaugucuuccugga

SEQ ID NO: 18471 - RNA, 19 nt, Artificial Sequence
  Synthetic oligonucleotide
caaagaugucuuccuggaa

SEQ ID NO: 18472 - RNA, 19 nt, Artificial Sequence
  Synthetic oligonucleotide
aaagaugucuuccuggaaa

SEQ ID NO: 18473 - RNA, 19 nt, Artificial Sequence
  Synthetic oligonucleotide
aagaugucuuccuggaaau

SEQ ID NO: 18474 - RNA, 19 nt, Artificial Sequence
  Synthetic oligonucleotide
gaugucuuccuggaaauga

SEQ ID NO: 18475 - RNA, 19 nt, Artificial Sequence
  Synthetic oligonucleotide
augucuuccuggaaaugaa

SEQ ID NO: 18476 - RNA, 19 nt, Artificial Sequence
  Synthetic oligonucleotide
ugucuuccuggaaaugaau

SEQ ID NO: 18477 - RNA, 19 nt, Artificial Sequence
  Synthetic oligonucleotide
gucuuccuggaaaugaaua

SEQ ID NO: 18478 - RNA, 19 nt, Artificial Sequence
  Synthetic oligonucleotide
ucuuccuggaaaugaauau

SEQ ID NO: 18479 - RNA, 19 nt, Artificial Sequence
  Synthetic oligonucleotide
cuuccuggaaaugaauaua

SEQ ID NO: 18480 - RNA, 19 nt, Artificial Sequence
  Synthetic oligonucleotide
uuccuggaaaugaauauac

SEQ ID NO: 18481 - RNA, 19 nt, Artificial Sequence
  Synthetic oligonucleotide
uccuggaaaugaauauacc

SEQ ID NO: 18482 - RNA, 19 nt, Artificial Sequence
  Synthetic oligonucleotide
auauaccauauucuguugu

SEQ ID NO: 18483 - RNA, 19 nt, Artificial Sequence
  Synthetic oligonucleotide
uauaccauauucuguugua

SEQ ID NO: 18484 - RNA, 19 nt, Artificial Sequence
  Synthetic oligonucleotide
auaccauauucuguuguac

SEQ ID NO: 18485 - RNA, 19 nt, Artificial Sequence
  Synthetic oligonucleotide
uaccauauucuguuguacg

SEQ ID NO: 18486 - RNA, 19 nt, Artificial Sequence
  Synthetic oligonucleotide
accauauucuguuguacga

SEQ ID NO: 18487 - RNA, 19 nt, Artificial Sequence
  Synthetic oligonucleotide
ccauauucuguuguacgag

SEQ ID NO: 18488 - RNA, 19 nt, Artificial Sequence
  Synthetic oligonucleotide
cauauucuguuguacgagg

SEQ ID NO: 18489 - RNA, 19 nt, Artificial Sequence
  Synthetic oligonucleotide
auauucuguuguacgagga

SEQ ID NO: 18490 - RNA, 19 nt, Artificial Sequence
  Synthetic oligonucleotide
uauucuguuguacgaggag

SEQ ID NO: 18491 - RNA, 19 nt, Artificial Sequence
  Synthetic oligonucleotide
auucuguuguacgaggaga

SEQ ID NO: 18492 - RNA, 19 nt, Artificial Sequence
  Synthetic oligonucleotide
uucuguuguacgaggagaa

SEQ ID NO: 18493 - RNA, 19 nt, Artificial Sequence
  Synthetic oligonucleotide
ucuguuguacgaggagaac

SEQ ID NO: 18494 - RNA, 19 nt, Artificial Sequence
  Synthetic oligonucleotide
cuguuguacgaggagaaca

SEQ ID NO: 18495 - RNA, 19 nt, Artificial Sequence
  Synthetic oligonucleotide
ggaacuguuuacaacuaua

SEQ ID NO: 18496 - RNA, 19 nt, Artificial Sequence
  Synthetic oligonucleotide
gaacuguuuacaacuauag

SEQ ID NO: 18497 - RNA, 19 nt, Artificial Sequence
  Synthetic oligonucleotide
aacuguuuacaacuauagg

SEQ ID NO: 18498 - RNA, 19 nt, Artificial Sequence
  Synthetic oligonucleotide
acuguuuacaacuauagga

SEQ ID NO: 18499 - RNA, 19 nt, Artificial Sequence
  Synthetic oligonucleotide
cuguuuacaacuauaggac

SEQ ID NO: 18500 - RNA, 19 nt, Artificial Sequence
  Synthetic oligonucleotide
uguuuacaacuauaggacu

SEQ ID NO: 18501 - RNA, 19 nt, Artificial Sequence
  Synthetic oligonucleotide
guuuacaacuauaggacuu

SEQ ID NO: 18502 - RNA, 19 nt, Artificial Sequence
  Synthetic oligonucleotide
uuuacaacuauaggacuuc

SEQ ID NO: 18503 - RNA, 19 nt, Artificial Sequence
  Synthetic oligonucleotide
uuacaacuauaggacuucu

SEQ ID NO: 18504 - RNA, 19 nt, Artificial Sequence
  Synthetic oligonucleotide
uacaacuauaggacuucug

SEQ ID NO: 18505 - RNA, 19 nt, Artificial Sequence
  Synthetic oligonucleotide
acaacuauaggacuucugg

SEQ ID NO: 18506 - RNA, 19 nt, Artificial Sequence
  Synthetic oligonucleotide
caacuauaggacuucuggg

SEQ ID NO: 18507 - RNA, 19 nt, Artificial Sequence
  Synthetic oligonucleotide
aacuauaggacuucuggga

SEQ ID NO: 18508 - RNA, 19 nt, Artificial Sequence
  Synthetic oligonucleotide
acuauaggacuucugggau

SEQ ID NO: 18509 - RNA, 19 nt, Artificial Sequence
  Synthetic oligonucleotide
cuauaggacuucugggaug

SEQ ID NO: 18510 - RNA, 19 nt, Artificial Sequence
  Synthetic oligonucleotide
uauaggacuucugggaugc

SEQ ID NO: 18511 - RNA, 19 nt, Artificial Sequence
  Synthetic oligonucleotide
auaggacuucugggaugca

SEQ ID NO: 18512 - RNA, 19 nt, Artificial Sequence
  Synthetic oligonucleotide
uaggacuucugggaugcag

SEQ ID NO: 18513 - RNA, 19 nt, Artificial Sequence
  Synthetic oligonucleotide
aaaugucugcuguggaggg

SEQ ID NO: 18514 - RNA, 19 nt, Artificial Sequence
  Synthetic oligonucleotide
aaugucugcuguggaggga

SEQ ID NO: 18515 - RNA, 19 nt, Artificial Sequence
  Synthetic oligonucleotide
augucugcuguggagggaa

SEQ ID NO: 18516 - RNA, 19 nt, Artificial Sequence
  Synthetic oligonucleotide
ugucugcuguggagggaau

SEQ ID NO: 18517 - RNA, 19 nt, Artificial Sequence
  Synthetic oligonucleotide
gucugcuguggagggaauc

SEQ ID NO: 18518 - RNA, 19 nt, Artificial Sequence
  Synthetic oligonucleotide
ucugcuguggagggaaucu

SEQ ID NO: 18519 - RNA, 19 nt, Artificial Sequence
  Synthetic oligonucleotide
cugcuguggagggaaucug

SEQ ID NO: 18520 - RNA, 19 nt, Artificial Sequence
  Synthetic oligonucleotide
ugcuguggagggaaucugc

SEQ ID NO: 18521 - RNA, 19 nt, Artificial Sequence
  Synthetic oligonucleotide
gcuguggagggaaucugca

SEQ ID NO: 18522 - RNA, 19 nt, Artificial Sequence
  Synthetic oligonucleotide
cuguggagggaaucugcac

SEQ ID NO: 18523 - RNA, 19 nt, Artificial Sequence
  Synthetic oligonucleotide
uguggagggaaucugcacu

SEQ ID NO: 18524 - RNA, 19 nt, Artificial Sequence
  Synthetic oligonucleotide
guggagggaaucugcacuu

SEQ ID NO: 18525 - RNA, 19 nt, Artificial Sequence
  Synthetic oligonucleotide
ggaaagcccagucauugau

SEQ ID NO: 18526 - RNA, 19 nt, Artificial Sequence
  Synthetic oligonucleotide
gaaagcccagucauugauc

SEQ ID NO: 18527 - RNA, 19 nt, Artificial Sequence
  Synthetic oligonucleotide
aaagcccagucauugauca

SEQ ID NO: 18528 - RNA, 19 nt, Artificial Sequence
  Synthetic oligonucleotide
aagcccagucauugaucau

SEQ ID NO: 18529 - RNA, 19 nt, Artificial Sequence
  Synthetic oligonucleotide
agcccagucauugaucauc

SEQ ID NO: 18530 - RNA, 19 nt, Artificial Sequence
  Synthetic oligonucleotide
gcccagucauugaucauca

SEQ ID NO: 18531 - RNA, 19 nt, Artificial Sequence
  Synthetic oligonucleotide
cccagucauugaucaucag

SEQ ID NO: 18532 - RNA, 19 nt, Artificial Sequence
  Synthetic oligonucleotide
ccagucauugaucaucagg

SEQ ID NO: 18533 - RNA, 19 nt, Artificial Sequence
  Synthetic oligonucleotide
cagucauugaucaucaggg

SEQ ID NO: 18534 - RNA, 19 nt, Artificial Sequence
  Synthetic oligonucleotide
agucauugaucaucagggc

SEQ ID NO: 18535 - RNA, 19 nt, Artificial Sequence
  Synthetic oligonucleotide
gucauugaucaucagggca

SEQ ID NO: 18536 - RNA, 19 nt, Artificial Sequence
  Synthetic oligonucleotide
ucauugaucaucagggcac

SEQ ID NO: 18537 - RNA, 19 nt, Artificial Sequence
  Synthetic oligonucleotide
cauugaucaucagggcaca

SEQ ID NO: 18538 - RNA, 19 nt, Artificial Sequence
  Synthetic oligonucleotide
auugaucaucagggcacaa

SEQ ID NO: 18539 - RNA, 19 nt, Artificial Sequence
  Synthetic oligonucleotide
uugaucaucagggcacaaa

SEQ ID NO: 18540 - RNA, 19 nt, Artificial Sequence
  Synthetic oligonucleotide
ugaucaucagggcacaaag

SEQ ID NO: 18541 - RNA, 19 nt, Artificial Sequence
  Synthetic oligonucleotide
gaucaucagggcacaaagu

SEQ ID NO: 18542 - RNA, 19 nt, Artificial Sequence
  Synthetic oligonucleotide
aucaucagggcacaaaguc

SEQ ID NO: 18543 - RNA, 19 nt, Artificial Sequence
  Synthetic oligonucleotide
ucaucagggcacaaagucc

SEQ ID NO: 18544 - RNA, 19 nt, Artificial Sequence
  Synthetic oligonucleotide
caucagggcacaaaguccu

SEQ ID NO: 18545 - RNA, 19 nt, Artificial Sequence
  Synthetic oligonucleotide
aucagggcacaaaguccuc

SEQ ID NO: 18546 - RNA, 19 nt, Artificial Sequence
  Synthetic oligonucleotide
ucagggcacaaaguccucc

SEQ ID NO: 18547 - RNA, 19 nt, Artificial Sequence
  Synthetic oligonucleotide
cagaaaguagagggcuccu

SEQ ID NO: 18548 - RNA, 19 nt, Artificial Sequence
  Synthetic oligonucleotide
cacugugcuuccucuggaa

SEQ ID NO: 18549 - RNA, 19 nt, Artificial Sequence
  Synthetic oligonucleotide
acugugcuuccucuggaaa

SEQ ID NO: 18550 - RNA, 19 nt, Artificial Sequence
  Synthetic oligonucleotide
cugugcuuccucuggaaau

SEQ ID NO: 18551 - RNA, 19 nt, Artificial Sequence
  Synthetic oligonucleotide
ugugcuuccucuggaaauu

SEQ ID NO: 18552 - RNA, 19 nt, Artificial Sequence
  Synthetic oligonucleotide
gguuuggaaaagaaaucuu

SEQ ID NO: 18553 - RNA, 19 nt, Artificial Sequence
  Synthetic oligonucleotide
guuuggaaaagaaaucuua

SEQ ID NO: 18554 - RNA, 19 nt, Artificial Sequence
  Synthetic oligonucleotide
uuuggaaaagaaaucuuag

SEQ ID NO: 18555 - RNA, 19 nt, Artificial Sequence
  Synthetic oligonucleotide
uuggaaaagaaaucuuagu

SEQ ID NO: 18556 - RNA, 19 nt, Artificial Sequence
  Synthetic oligonucleotide
uggaaaagaaaucuuagua

SEQ ID NO: 18557 - RNA, 19 nt, Artificial Sequence
  Synthetic oligonucleotide
ggaaaagaaaucuuaguaa

SEQ ID NO: 18558 - RNA, 19 nt, Artificial Sequence
  Synthetic oligonucleotide
gaaaagaaaucuuaguaaa

SEQ ID NO: 18559 - RNA, 19 nt, Artificial Sequence
  Synthetic oligonucleotide
auuacgaguggugccagaa

SEQ ID NO: 18560 - RNA, 19 nt, Artificial Sequence
  Synthetic oligonucleotide
uuacgaguggugccagaag

SEQ ID NO: 18561 - RNA, 19 nt, Artificial Sequence
  Synthetic oligonucleotide
uacgaguggugccagaagg

SEQ ID NO: 18562 - RNA, 19 nt, Artificial Sequence
  Synthetic oligonucleotide
acgaguggugccagaaggu

SEQ ID NO: 18563 - RNA, 19 nt, Artificial Sequence
  Synthetic oligonucleotide
cgaguggugccagaaggug

SEQ ID NO: 18564 - RNA, 19 nt, Artificial Sequence
  Synthetic oligonucleotide
gaguggugccagaaggugu

SEQ ID NO: 18565 - RNA, 19 nt, Artificial Sequence
  Synthetic oligonucleotide
aguggugccagaagguguc

SEQ ID NO: 18566 - RNA, 19 nt, Artificial Sequence
  Synthetic oligonucleotide
guggugccagaagguguca

SEQ ID NO: 18567 - RNA, 19 nt, Artificial Sequence
  Synthetic oligonucleotide
uggugccagaaggugucaa

SEQ ID NO: 18568 - RNA, 19 nt, Artificial Sequence
  Synthetic oligonucleotide
ggugccagaaggugucaaa

SEQ ID NO: 18569 - RNA, 19 nt, Artificial Sequence
  Synthetic oligonucleotide
gugccagaaggugucaaaa

SEQ ID NO: 18570 - RNA, 19 nt, Artificial Sequence
  Synthetic oligonucleotide
ugccagaaggugucaaaag

SEQ ID NO: 18571 - RNA, 19 nt, Artificial Sequence
  Synthetic oligonucleotide
gccagaaggugucaaaagg

SEQ ID NO: 18572 - RNA, 19 nt, Artificial Sequence
  Synthetic oligonucleotide
ccagaaggugucaaaaggg

SEQ ID NO: 18573 - RNA, 19 nt, Artificial Sequence
  Synthetic oligonucleotide
cagaaggugucaaaaggga

SEQ ID NO: 18574 - RNA, 19 nt, Artificial Sequence
  Synthetic oligonucleotide
agaaggugucaaaagggaa

SEQ ID NO: 18575 - RNA, 19 nt, Artificial Sequence
  Synthetic oligonucleotide
gaaggugucaaaagggaaa

SEQ ID NO: 18576 - RNA, 19 nt, Artificial Sequence
  Synthetic oligonucleotide
aaggugucaaaagggaaag

SEQ ID NO: 18577 - RNA, 19 nt, Artificial Sequence
  Synthetic oligonucleotide
aggugucaaaagggaaagc

SEQ ID NO: 18578 - RNA, 19 nt, Artificial Sequence
  Synthetic oligonucleotide
ggugucaaaagggaaagcu

SEQ ID NO: 18579 - RNA, 19 nt, Artificial Sequence
  Synthetic oligonucleotide
gugucaaaagggaaagcua

SEQ ID NO: 18580 - RNA, 19 nt, Artificial Sequence
  Synthetic oligonucleotide
ugucaaaagggaaagcuau

SEQ ID NO: 18581 - RNA, 19 nt, Artificial Sequence
  Synthetic oligonucleotide
gucaaaagggaaagcuauu

SEQ ID NO: 18582 - RNA, 19 nt, Artificial Sequence
  Synthetic oligonucleotide
ucaaaagggaaagcuauuc

SEQ ID NO: 18583 - RNA, 19 nt, Artificial Sequence
  Synthetic oligonucleotide
caaaagggaaagcuauucu

SEQ ID NO: 18584 - RNA, 19 nt, Artificial Sequence
  Synthetic oligonucleotide
aaaagggaaagcuauucug

SEQ ID NO: 18585 - RNA, 19 nt, Artificial Sequence
  Synthetic oligonucleotide
aaagggaaagcuauucugg

SEQ ID NO: 18586 - RNA, 19 nt, Artificial Sequence
  Synthetic oligonucleotide
guuacuuuggauccuaggg

SEQ ID NO: 18587 - RNA, 19 nt, Artificial Sequence
  Synthetic oligonucleotide
uuacuuuggauccuagggg

SEQ ID NO: 18588 - RNA, 19 nt, Artificial Sequence
  Synthetic oligonucleotide
uacuuuggauccuaggggu

SEQ ID NO: 18589 - RNA, 19 nt, Artificial Sequence
  Synthetic oligonucleotide
acuuuggauccuaggggua

SEQ ID NO: 18590 - RNA, 19 nt, Artificial Sequence
  Synthetic oligonucleotide
cuuuggauccuagggguau

SEQ ID NO: 18591 - RNA, 19 nt, Artificial Sequence
  Synthetic oligonucleotide
uuuggauccuagggguauu

SEQ ID NO: 18592 - RNA, 19 nt, Artificial Sequence
  Synthetic oligonucleotide
uuggauccuagggguauuu

SEQ ID NO: 18593 - RNA, 19 nt, Artificial Sequence
  Synthetic oligonucleotide
uggauccuagggguauuua

SEQ ID NO: 18594 - RNA, 19 nt, Artificial Sequence
  Synthetic oligonucleotide
ggauccuagggguauuuau

SEQ ID NO: 18595 - RNA, 19 nt, Artificial Sequence
  Synthetic oligonucleotide
acgaaaggaguucccauac

SEQ ID NO: 18596 - RNA, 19 nt, Artificial Sequence
  Synthetic oligonucleotide
cgaaaggaguucccauaca

SEQ ID NO: 18597 - RNA, 19 nt, Artificial Sequence
  Synthetic oligonucleotide
gaaaggaguucccauacag

SEQ ID NO: 18598 - RNA, 19 nt, Artificial Sequence
  Synthetic oligonucleotide
aaaggaguucccauacagg

SEQ ID NO: 18599 - RNA, 19 nt, Artificial Sequence
  Synthetic oligonucleotide
aaggaguucccauacagga

SEQ ID NO: 18600 - RNA, 19 nt, Artificial Sequence
  Synthetic oligonucleotide
aggaguucccauacaggau

SEQ ID NO: 18601 - RNA, 19 nt, Artificial Sequence
  Synthetic oligonucleotide
ggaguucccauacaggaua

SEQ ID NO: 18602 - RNA, 19 nt, Artificial Sequence
  Synthetic oligonucleotide
gaguucccauacaggauac

SEQ ID NO: 18603 - RNA, 19 nt, Artificial Sequence
  Synthetic oligonucleotide
cuuagauuugguccccaaa

SEQ ID NO: 18604 - RNA, 19 nt, Artificial Sequence
  Synthetic oligonucleotide
uuagauuugguccccaaaa

SEQ ID NO: 18605 - RNA, 19 nt, Artificial Sequence
  Synthetic oligonucleotide
uagauuugguccccaaaac

SEQ ID NO: 18606 - RNA, 19 nt, Artificial Sequence
  Synthetic oligonucleotide
agauuugguccccaaaaca

SEQ ID NO: 18607 - RNA, 19 nt, Artificial Sequence
  Synthetic oligonucleotide
gauuugguccccaaaacag

SEQ ID NO: 18608 - RNA, 19 nt, Artificial Sequence
  Synthetic oligonucleotide
auuugguccccaaaacaga

SEQ ID NO: 18609 - RNA, 19 nt, Artificial Sequence
  Synthetic oligonucleotide
uuugguccccaaaacagaa

SEQ ID NO: 18610 - RNA, 19 nt, Artificial Sequence
  Synthetic oligonucleotide
uugguccccaaaacagaaa

SEQ ID NO: 18611 - RNA, 19 nt, Artificial Sequence
  Synthetic oligonucleotide
ugguccccaaaacagaaau

SEQ ID NO: 18612 - RNA, 19 nt, Artificial Sequence
  Synthetic oligonucleotide
gguccccaaaacagaaauc

SEQ ID NO: 18613 - RNA, 19 nt, Artificial Sequence
  Synthetic oligonucleotide
guccccaaaacagaaauca

SEQ ID NO: 18614 - RNA, 19 nt, Artificial Sequence
  Synthetic oligonucleotide
uccccaaaacagaaaucaa

SEQ ID NO: 18615 - RNA, 19 nt, Artificial Sequence
  Synthetic oligonucleotide
ccccaaaacagaaaucaaa

SEQ ID NO: 18616 - RNA, 19 nt, Artificial Sequence
  Synthetic oligonucleotide
cccaaaacagaaaucaaaa

SEQ ID NO: 18617 - RNA, 19 nt, Artificial Sequence
  Synthetic oligonucleotide
ccaaaacagaaaucaaaag

SEQ ID NO: 18618 - RNA, 19 nt, Artificial Sequence
  Synthetic oligonucleotide
caaaacagaaaucaaaagg

SEQ ID NO: 18619 - RNA, 19 nt, Artificial Sequence
  Synthetic oligonucleotide
aaaacagaaaucaaaagga

SEQ ID NO: 18620 - RNA, 19 nt, Artificial Sequence
  Synthetic oligonucleotide
aaacagaaaucaaaaggau

SEQ ID NO: 18621 - RNA, 19 nt, Artificial Sequence
  Synthetic oligonucleotide
aacagaaaucaaaaggauu

SEQ ID NO: 18622 - RNA, 19 nt, Artificial Sequence
  Synthetic oligonucleotide
acagaaaucaaaaggauuu

SEQ ID NO: 18623 - RNA, 19 nt, Artificial Sequence
  Synthetic oligonucleotide
gaaaucaaaaggauuuuga

SEQ ID NO: 18624 - RNA, 19 nt, Artificial Sequence
  Synthetic oligonucleotide
aaaucaaaaggauuuugag

SEQ ID NO: 18625 - RNA, 19 nt, Artificial Sequence
  Synthetic oligonucleotide
aaucaaaaggauuuugagu

SEQ ID NO: 18626 - RNA, 19 nt, Artificial Sequence
  Synthetic oligonucleotide
aucaaaaggauuuugagug

SEQ ID NO: 18627 - RNA, 19 nt, Artificial Sequence
  Synthetic oligonucleotide
caaaaggauuuugagugua

SEQ ID NO: 18628 - RNA, 19 nt, Artificial Sequence
  Synthetic oligonucleotide
aaaaggauuuugaguguaa

SEQ ID NO: 18629 - RNA, 19 nt, Artificial Sequence
  Synthetic oligonucleotide
aaaggauuuugaguguaaa

SEQ ID NO: 18630 - RNA, 19 nt, Artificial Sequence
  Synthetic oligonucleotide
aaggauuuugaguguaaaa

SEQ ID NO: 18631 - RNA, 19 nt, Artificial Sequence
  Synthetic oligonucleotide
aggauuuugaguguaaaag

SEQ ID NO: 18632 - RNA, 19 nt, Artificial Sequence
  Synthetic oligonucleotide
ggauuuugaguguaaaagg

SEQ ID NO: 18633 - RNA, 19 nt, Artificial Sequence
  Synthetic oligonucleotide
gauuuugaguguaaaagga

SEQ ID NO: 18634 - RNA, 19 nt, Artificial Sequence
  Synthetic oligonucleotide
auuuugaguguaaaaggac

SEQ ID NO: 18635 - RNA, 19 nt, Artificial Sequence
  Synthetic oligonucleotide
uuuugaguguaaaaggacu

SEQ ID NO: 18636 - RNA, 19 nt, Artificial Sequence
  Synthetic oligonucleotide
uuugaguguaaaaggacug

SEQ ID NO: 18637 - RNA, 19 nt, Artificial Sequence
  Synthetic oligonucleotide
uugaguguaaaaggacugc

SEQ ID NO: 18638 - RNA, 19 nt, Artificial Sequence
  Synthetic oligonucleotide
ugaguguaaaaggacugcu

SEQ ID NO: 18639 - RNA, 19 nt, Artificial Sequence
  Synthetic oligonucleotide
gaguguaaaaggacugcuu

SEQ ID NO: 18640 - RNA, 19 nt, Artificial Sequence
  Synthetic oligonucleotide
aguguaaaaggacugcuug

SEQ ID NO: 18641 - RNA, 19 nt, Artificial Sequence
  Synthetic oligonucleotide
guguaaaaggacugcuugu

SEQ ID NO: 18642 - RNA, 19 nt, Artificial Sequence
  Synthetic oligonucleotide
uguaaaaggacugcuugua

SEQ ID NO: 18643 - RNA, 19 nt, Artificial Sequence
  Synthetic oligonucleotide
guaaaaggacugcuuguag

SEQ ID NO: 18644 - RNA, 19 nt, Artificial Sequence
  Synthetic oligonucleotide
uaaaaggacugcuuguagg

SEQ ID NO: 18645 - RNA, 19 nt, Artificial Sequence
  Synthetic oligonucleotide
aaaaggacugcuuguaggu

SEQ ID NO: 18646 - RNA, 19 nt, Artificial Sequence
  Synthetic oligonucleotide
aaaggacugcuuguaggug

SEQ ID NO: 18647 - RNA, 19 nt, Artificial Sequence
  Synthetic oligonucleotide
aaggacugcuuguagguga

SEQ ID NO: 18648 - RNA, 19 nt, Artificial Sequence
  Synthetic oligonucleotide
aggacugcuuguaggugag

SEQ ID NO: 18649 - RNA, 19 nt, Artificial Sequence
  Synthetic oligonucleotide
ggacugcuuguaggugaga

SEQ ID NO: 18650 - RNA, 19 nt, Artificial Sequence
  Synthetic oligonucleotide
gacugcuuguaggugagau

SEQ ID NO: 18651 - RNA, 19 nt, Artificial Sequence
  Synthetic oligonucleotide
acugcuuguaggugagauc

SEQ ID NO: 18652 - RNA, 19 nt, Artificial Sequence
  Synthetic oligonucleotide
cugcuuguaggugagaucu

SEQ ID NO: 18653 - RNA, 19 nt, Artificial Sequence
  Synthetic oligonucleotide
ugcuuguaggugagaucuu

SEQ ID NO: 18654 - RNA, 19 nt, Artificial Sequence
  Synthetic oligonucleotide
gcuuguaggugagaucuug

SEQ ID NO: 18655 - RNA, 19 nt, Artificial Sequence
  Synthetic oligonucleotide
cuuguaggugagaucuugu

SEQ ID NO: 18656 - RNA, 19 nt, Artificial Sequence
  Synthetic oligonucleotide
uuguaggugagaucuuguc

SEQ ID NO: 18657 - RNA, 19 nt, Artificial Sequence
  Synthetic oligonucleotide
uguaggugagaucuugucu

SEQ ID NO: 18658 - RNA, 19 nt, Artificial Sequence
  Synthetic oligonucleotide
guaggugagaucuugucug

SEQ ID NO: 18659 - RNA, 19 nt, Artificial Sequence
  Synthetic oligonucleotide
uaggugagaucuugucugc

SEQ ID NO: 18660 - RNA, 19 nt, Artificial Sequence
  Synthetic oligonucleotide
aggugagaucuugucugca

SEQ ID NO: 18661 - RNA, 19 nt, Artificial Sequence
  Synthetic oligonucleotide
ggugagaucuugucugcag

SEQ ID NO: 18662 - RNA, 19 nt, Artificial Sequence
  Synthetic oligonucleotide
gugagaucuugucugcagu

SEQ ID NO: 18663 - RNA, 19 nt, Artificial Sequence
  Synthetic oligonucleotide
ugagaucuugucugcaguu

SEQ ID NO: 18664 - RNA, 19 nt, Artificial Sequence
  Synthetic oligonucleotide
gagaucuugucugcaguuc

SEQ ID NO: 18665 - RNA, 19 nt, Artificial Sequence
  Synthetic oligonucleotide
agaucuugucugcaguucu

SEQ ID NO: 18666 - RNA, 19 nt, Artificial Sequence
  Synthetic oligonucleotide
gaucuugucugcaguucua

SEQ ID NO: 18667 - RNA, 19 nt, Artificial Sequence
  Synthetic oligonucleotide
aucuugucugcaguucuaa

SEQ ID NO: 18668 - RNA, 19 nt, Artificial Sequence
  Synthetic oligonucleotide
ucuugucugcaguucuaag

SEQ ID NO: 18669 - RNA, 19 nt, Artificial Sequence
  Synthetic oligonucleotide
cuugucugcaguucuaagu

SEQ ID NO: 18670 - RNA, 19 nt, Artificial Sequence
  Synthetic oligonucleotide
aggaaggcaucaauauccu

SEQ ID NO: 18671 - RNA, 19 nt, Artificial Sequence
  Synthetic oligonucleotide
ggaaggcaucaauauccua

SEQ ID NO: 18672 - RNA, 19 nt, Artificial Sequence
  Synthetic oligonucleotide
gaaggcaucaauauccuaa

SEQ ID NO: 18673 - RNA, 19 nt, Artificial Sequence
  Synthetic oligonucleotide
aaggcaucaauauccuaac

SEQ ID NO: 18674 - RNA, 19 nt, Artificial Sequence
  Synthetic oligonucleotide
aggcaucaauauccuaacc

SEQ ID NO: 18675 - RNA, 19 nt, Artificial Sequence
  Synthetic oligonucleotide
ggcaucaauauccuaaccc

SEQ ID NO: 18676 - RNA, 19 nt, Artificial Sequence
  Synthetic oligonucleotide
gcaucaauauccuaaccca

SEQ ID NO: 18677 - RNA, 19 nt, Artificial Sequence
  Synthetic oligonucleotide
caucaauauccuaacccac

SEQ ID NO: 18678 - RNA, 19 nt, Artificial Sequence
  Synthetic oligonucleotide
aucaauauccuaacccacc

SEQ ID NO: 18679 - RNA, 19 nt, Artificial Sequence
  Synthetic oligonucleotide
ucaauauccuaacccaccu

SEQ ID NO: 18680 - RNA, 19 nt, Artificial Sequence
  Synthetic oligonucleotide
caauauccuaacccaccuc

SEQ ID NO: 18681 - RNA, 19 nt, Artificial Sequence
  Synthetic oligonucleotide
aauauccuaacccaccucc

SEQ ID NO: 18682 - RNA, 19 nt, Artificial Sequence
  Synthetic oligonucleotide
auauccuaacccaccuccc

SEQ ID NO: 18683 - RNA, 19 nt, Artificial Sequence
  Synthetic oligonucleotide
uaacccaccuccccaaagg

SEQ ID NO: 18684 - RNA, 19 nt, Artificial Sequence
  Synthetic oligonucleotide
aacccaccuccccaaaggg

SEQ ID NO: 18685 - RNA, 19 nt, Artificial Sequence
  Synthetic oligonucleotide
acccaccuccccaaaggga

SEQ ID NO: 18686 - RNA, 19 nt, Artificial Sequence
  Synthetic oligonucleotide
agaggcggagcugaugagc

SEQ ID NO: 18687 - RNA, 19 nt, Artificial Sequence
  Synthetic oligonucleotide
ggcggagcugaugagcguu

SEQ ID NO: 18688 - RNA, 19 nt, Artificial Sequence
  Synthetic oligonucleotide
gcggagcugaugagcguug

SEQ ID NO: 18689 - RNA, 19 nt, Artificial Sequence
  Synthetic oligonucleotide
cggagcugaugagcguugu

SEQ ID NO: 18690 - RNA, 19 nt, Artificial Sequence
  Synthetic oligonucleotide
ggagcugaugagcguuguc

SEQ ID NO: 18691 - RNA, 19 nt, Artificial Sequence
  Synthetic oligonucleotide
gagcugaugagcguugucc

SEQ ID NO: 18692 - RNA, 19 nt, Artificial Sequence
  Synthetic oligonucleotide
agcugaugagcguuguccc

SEQ ID NO: 18693 - RNA, 19 nt, Artificial Sequence
  Synthetic oligonucleotide
gcugaugagcguuguccca

SEQ ID NO: 18694 - RNA, 19 nt, Artificial Sequence
  Synthetic oligonucleotide
cugaugagcguugucccag

SEQ ID NO: 18695 - RNA, 19 nt, Artificial Sequence
  Synthetic oligonucleotide
ugaugagcguugucccagu

SEQ ID NO: 18696 - RNA, 19 nt, Artificial Sequence
  Synthetic oligonucleotide
gaugagcguugucccagua

SEQ ID NO: 18697 - RNA, 19 nt, Artificial Sequence
  Synthetic oligonucleotide
augagcguugucccaguau

SEQ ID NO: 18698 - RNA, 19 nt, Artificial Sequence
  Synthetic oligonucleotide
ugagcguugucccaguauu

SEQ ID NO: 18699 - RNA, 19 nt, Artificial Sequence
  Synthetic oligonucleotide
gagcguugucccaguauuc

SEQ ID NO: 18700 - RNA, 19 nt, Artificial Sequence
  Synthetic oligonucleotide
agcguugucccaguauucu

SEQ ID NO: 18701 - RNA, 19 nt, Artificial Sequence
  Synthetic oligonucleotide
gcguugucccaguauucua

SEQ ID NO: 18702 - RNA, 19 nt, Artificial Sequence
  Synthetic oligonucleotide
cguugucccaguauucuau

SEQ ID NO: 18703 - RNA, 19 nt, Artificial Sequence
  Synthetic oligonucleotide
guugucccaguauucuaug

SEQ ID NO: 18704 - RNA, 19 nt, Artificial Sequence
  Synthetic oligonucleotide
uugucccaguauucuaugu

SEQ ID NO: 18705 - RNA, 19 nt, Artificial Sequence
  Synthetic oligonucleotide
ugucccaguauucuauguu

SEQ ID NO: 18706 - RNA, 19 nt, Artificial Sequence
  Synthetic oligonucleotide
gucccaguauucuauguuu

SEQ ID NO: 18707 - RNA, 19 nt, Artificial Sequence
  Synthetic oligonucleotide
ucccaguauucuauguuuu

SEQ ID NO: 18708 - RNA, 19 nt, Artificial Sequence
  Synthetic oligonucleotide
ccaguauucuauguuuuuc

SEQ ID NO: 18709 - RNA, 19 nt, Artificial Sequence
  Synthetic oligonucleotide
caguauucuauguuuuuca

SEQ ID NO: 18710 - RNA, 19 nt, Artificial Sequence
  Synthetic oligonucleotide
aguauucuauguuuuucac

SEQ ID NO: 18711 - RNA, 19 nt, Artificial Sequence
  Synthetic oligonucleotide
guauucuauguuuuucacu

SEQ ID NO: 18712 - RNA, 19 nt, Artificial Sequence
  Synthetic oligonucleotide
uauucuauguuuuucacua

SEQ ID NO: 18713 - RNA, 19 nt, Artificial Sequence
  Synthetic oligonucleotide
auucuauguuuuucacuac

SEQ ID NO: 18714 - RNA, 19 nt, Artificial Sequence
  Synthetic oligonucleotide
uucuauguuuuucacuacc

SEQ ID NO: 18715 - RNA, 19 nt, Artificial Sequence
  Synthetic oligonucleotide
ucuauguuuuucacuaccu

SEQ ID NO: 18716 - RNA, 19 nt, Artificial Sequence
  Synthetic oligonucleotide
cuauguuuuucacuaccug

SEQ ID NO: 18717 - RNA, 19 nt, Artificial Sequence
  Synthetic oligonucleotide
uauguuuuucacuaccugg

SEQ ID NO: 18718 - RNA, 19 nt, Artificial Sequence
  Synthetic oligonucleotide
auguuuuucacuaccugga

SEQ ID NO: 18719 - RNA, 19 nt, Artificial Sequence
  Synthetic oligonucleotide
uguuuuucacuaccuggaa

SEQ ID NO: 18720 - RNA, 19 nt, Artificial Sequence
  Synthetic oligonucleotide
guuuuucacuaccuggaaa

SEQ ID NO: 18721 - RNA, 19 nt, Artificial Sequence
  Synthetic oligonucleotide
uuuuucacuaccuggaaac

SEQ ID NO: 18722 - RNA, 19 nt, Artificial Sequence
  Synthetic oligonucleotide
uuuucacuaccuggaaaca

SEQ ID NO: 18723 - RNA, 19 nt, Artificial Sequence
  Synthetic oligonucleotide
uuucacuaccuggaaacag

SEQ ID NO: 18724 - RNA, 19 nt, Artificial Sequence
  Synthetic oligonucleotide
uucacuaccuggaaacagg

SEQ ID NO: 18725 - RNA, 19 nt, Artificial Sequence
  Synthetic oligonucleotide
ucacuaccuggaaacagga

SEQ ID NO: 18726 - RNA, 19 nt, Artificial Sequence
  Synthetic oligonucleotide
cacuaccuggaaacaggaa

SEQ ID NO: 18727 - RNA, 19 nt, Artificial Sequence
  Synthetic oligonucleotide
acuaccuggaaacaggaaa

SEQ ID NO: 18728 - RNA, 19 nt, Artificial Sequence
  Synthetic oligonucleotide
cuaccuggaaacaggaaau

SEQ ID NO: 18729 - RNA, 19 nt, Artificial Sequence
  Synthetic oligonucleotide
uaccuggaaacaggaaauc

SEQ ID NO: 18730 - RNA, 19 nt, Artificial Sequence
  Synthetic oligonucleotide
accuggaaacaggaaauca

SEQ ID NO: 18731 - RNA, 19 nt, Artificial Sequence
  Synthetic oligonucleotide
ccuggaaacaggaaaucau

SEQ ID NO: 18732 - RNA, 19 nt, Artificial Sequence
  Synthetic oligonucleotide
cuggaaacaggaaaucauu

SEQ ID NO: 18733 - RNA, 19 nt, Artificial Sequence
  Synthetic oligonucleotide
uggaaacaggaaaucauug

SEQ ID NO: 18734 - RNA, 19 nt, Artificial Sequence
  Synthetic oligonucleotide
ggaaacaggaaaucauugg

SEQ ID NO: 18735 - RNA, 19 nt, Artificial Sequence
  Synthetic oligonucleotide
gaaacaggaaaucauugga

SEQ ID NO: 18736 - RNA, 19 nt, Artificial Sequence
  Synthetic oligonucleotide
aaacaggaaaucauuggaa

SEQ ID NO: 18737 - RNA, 19 nt, Artificial Sequence
  Synthetic oligonucleotide
aacaggaaaucauuggaac

SEQ ID NO: 18738 - RNA, 19 nt, Artificial Sequence
  Synthetic oligonucleotide
acaggaaaucauuggaaca

SEQ ID NO: 18739 - RNA, 19 nt, Artificial Sequence
  Synthetic oligonucleotide
ggaaaucauuggaacauuu

SEQ ID NO: 18740 - RNA, 19 nt, Artificial Sequence
  Synthetic oligonucleotide
gaaaucauuggaacauuuu

SEQ ID NO: 18741 - RNA, 19 nt, Artificial Sequence
  Synthetic oligonucleotide
aaaucauuggaacauuuuu

SEQ ID NO: 18742 - RNA, 19 nt, Artificial Sequence
  Synthetic oligonucleotide
aaucauuggaacauuuuuc

SEQ ID NO: 18743 - RNA, 19 nt, Artificial Sequence
  Synthetic oligonucleotide
aucauuggaacauuuuuca

SEQ ID NO: 18744 - RNA, 19 nt, Artificial Sequence
  Synthetic oligonucleotide
ucauuggaacauuuuucau

SEQ ID NO: 18745 - RNA, 19 nt, Artificial Sequence
  Synthetic oligonucleotide
cauuggaacauuuuucauu

SEQ ID NO: 18746 - RNA, 19 nt, Artificial Sequence
  Synthetic oligonucleotide
ugacccauuaauugaaaag

SEQ ID NO: 18747 - RNA, 19 nt, Artificial Sequence
  Synthetic oligonucleotide
aagaaaaaauuaaaagaag

SEQ ID NO: 18748 - RNA, 19 nt, Artificial Sequence
  Synthetic oligonucleotide
agaaaaaauuaaaagaagg

SEQ ID NO: 18749 - RNA, 19 nt, Artificial Sequence
  Synthetic oligonucleotide
gaaaaaauuaaaagaaggg

SEQ ID NO: 18750 - RNA, 19 nt, Artificial Sequence
  Synthetic oligonucleotide
aaaaaauuaaaagaaggga

SEQ ID NO: 18751 - RNA, 19 nt, Artificial Sequence
  Synthetic oligonucleotide
aaaaauuaaaagaagggau

SEQ ID NO: 18752 - RNA, 19 nt, Artificial Sequence
  Synthetic oligonucleotide
uugagcauuauguccuaca

SEQ ID NO: 18753 - RNA, 19 nt, Artificial Sequence
  Synthetic oligonucleotide
gagcauuauguccuacaga

SEQ ID NO: 18754 - RNA, 19 nt, Artificial Sequence
  Synthetic oligonucleotide
agcauuauguccuacagaa

SEQ ID NO: 18755 - RNA, 19 nt, Artificial Sequence
  Synthetic oligonucleotide
gcauuauguccuacagaaa

SEQ ID NO: 18756 - RNA, 19 nt, Artificial Sequence
  Synthetic oligonucleotide
cauuauguccuacagaaau

SEQ ID NO: 18757 - RNA, 19 nt, Artificial Sequence
  Synthetic oligonucleotide
auuauguccuacagaaaug

SEQ ID NO: 18758 - RNA, 19 nt, Artificial Sequence
  Synthetic oligonucleotide
uuauguccuacagaaaugc

SEQ ID NO: 18759 - RNA, 19 nt, Artificial Sequence
  Synthetic oligonucleotide
uauguccuacagaaaugcu

SEQ ID NO: 18760 - RNA, 19 nt, Artificial Sequence
  Synthetic oligonucleotide
auguccuacagaaaugcug

SEQ ID NO: 18761 - RNA, 19 nt, Artificial Sequence
  Synthetic oligonucleotide
uguccuacagaaaugcuga

SEQ ID NO: 18762 - RNA, 19 nt, Artificial Sequence
  Synthetic oligonucleotide
guccuacagaaaugcugac

SEQ ID NO: 18763 - RNA, 19 nt, Artificial Sequence
  Synthetic oligonucleotide
uccuacagaaaugcugacu

SEQ ID NO: 18764 - RNA, 19 nt, Artificial Sequence
  Synthetic oligonucleotide
aagugcuagcacuugguua

SEQ ID NO: 18765 - RNA, 19 nt, Artificial Sequence
  Synthetic oligonucleotide
agugcuagcacuugguuaa

SEQ ID NO: 18766 - RNA, 19 nt, Artificial Sequence
  Synthetic oligonucleotide
gugcuagcacuugguuaac

SEQ ID NO: 18767 - RNA, 19 nt, Artificial Sequence
  Synthetic oligonucleotide
ugcuagcacuugguuaaca

SEQ ID NO: 18768 - RNA, 19 nt, Artificial Sequence
  Synthetic oligonucleotide
gcuagcacuugguuaacag

SEQ ID NO: 18769 - RNA, 19 nt, Artificial Sequence
  Synthetic oligonucleotide
cuagcacuugguuaacagc

SEQ ID NO: 18770 - RNA, 19 nt, Artificial Sequence
  Synthetic oligonucleotide
uagcacuugguuaacagcu

SEQ ID NO: 18771 - RNA, 19 nt, Artificial Sequence
  Synthetic oligonucleotide
agcacuugguuaacagcuu

SEQ ID NO: 18772 - RNA, 19 nt, Artificial Sequence
  Synthetic oligonucleotide
gcacuugguuaacagcuuu

SEQ ID NO: 18773 - RNA, 19 nt, Artificial Sequence
  Synthetic oligonucleotide
cacuugguuaacagcuuuu

SEQ ID NO: 18774 - RNA, 19 nt, Artificial Sequence
  Synthetic oligonucleotide
cuugguuaacagcuuuugc

SEQ ID NO: 18775 - RNA, 19 nt, Artificial Sequence
  Synthetic oligonucleotide
uugguuaacagcuuuugcu

SEQ ID NO: 18776 - RNA, 19 nt, Artificial Sequence
  Synthetic oligonucleotide
guuaacagcuuuugcuuua

SEQ ID NO: 18777 - RNA, 19 nt, Artificial Sequence
  Synthetic oligonucleotide
uuaacagcuuuugcuuuaa

SEQ ID NO: 18778 - RNA, 19 nt, Artificial Sequence
  Synthetic oligonucleotide
uaacagcuuuugcuuuaag

SEQ ID NO: 18779 - RNA, 19 nt, Artificial Sequence
  Synthetic oligonucleotide
aacagcuuuugcuuuaaga

SEQ ID NO: 18780 - RNA, 19 nt, Artificial Sequence
  Synthetic oligonucleotide
acagcuuuugcuuuaagag

SEQ ID NO: 18781 - RNA, 19 nt, Artificial Sequence
  Synthetic oligonucleotide
cagcuuuugcuuuaagagu

SEQ ID NO: 18782 - RNA, 19 nt, Artificial Sequence
  Synthetic oligonucleotide
agcuuuugcuuuaagagua

SEQ ID NO: 18783 - RNA, 19 nt, Artificial Sequence
  Synthetic oligonucleotide
gcuuuugcuuuaagaguac

SEQ ID NO: 18784 - RNA, 19 nt, Artificial Sequence
  Synthetic oligonucleotide
cuuuugcuuuaagaguacu

SEQ ID NO: 18785 - RNA, 19 nt, Artificial Sequence
  Synthetic oligonucleotide
uuuugcuuuaagaguacuu

SEQ ID NO: 18786 - RNA, 19 nt, Artificial Sequence
  Synthetic oligonucleotide
uuugcuuuaagaguacuug

SEQ ID NO: 18787 - RNA, 19 nt, Artificial Sequence
  Synthetic oligonucleotide
uugcuuuaagaguacuugg

SEQ ID NO: 18788 - RNA, 19 nt, Artificial Sequence
  Synthetic oligonucleotide
cuuuaagaguacuuggaca

SEQ ID NO: 18789 - RNA, 19 nt, Artificial Sequence
  Synthetic oligonucleotide
uuuaagaguacuuggacaa

SEQ ID NO: 18790 - RNA, 19 nt, Artificial Sequence
  Synthetic oligonucleotide
cguagagcagaaccaaaau

SEQ ID NO: 18791 - RNA, 19 nt, Artificial Sequence
  Synthetic oligonucleotide
uuguaauucuuuauugugg

SEQ ID NO: 18792 - RNA, 19 nt, Artificial Sequence
  Synthetic oligonucleotide
uguaauucuuuauuguggc

SEQ ID NO: 18793 - RNA, 19 nt, Artificial Sequence
  Synthetic oligonucleotide
uuucaaggaaaauucacag

SEQ ID NO: 18794 - RNA, 19 nt, Artificial Sequence
  Synthetic oligonucleotide
uucaaggaaaauucacagu

SEQ ID NO: 18795 - RNA, 19 nt, Artificial Sequence
  Synthetic oligonucleotide
ucaaggaaaauucacagua

SEQ ID NO: 18796 - RNA, 19 nt, Artificial Sequence
  Synthetic oligonucleotide
caaggaaaauucacaguau

SEQ ID NO: 18797 - RNA, 19 nt, Artificial Sequence
  Synthetic oligonucleotide
aaggaaaauucacaguauc

SEQ ID NO: 18798 - RNA, 19 nt, Artificial Sequence
  Synthetic oligonucleotide
aggaaaauucacaguauca

SEQ ID NO: 18799 - RNA, 19 nt, Artificial Sequence
  Synthetic oligonucleotide
ggaaaauucacaguaucaa

SEQ ID NO: 18800 - RNA, 19 nt, Artificial Sequence
  Synthetic oligonucleotide
gaaaauucacaguaucaac

SEQ ID NO: 18801 - RNA, 19 nt, Artificial Sequence
  Synthetic oligonucleotide
aaaauucacaguaucaacc

SEQ ID NO: 18802 - RNA, 19 nt, Artificial Sequence
  Synthetic oligonucleotide
aaauucacaguaucaacca

SEQ ID NO: 18803 - RNA, 19 nt, Artificial Sequence
  Synthetic oligonucleotide
aauucacaguaucaaccaa

SEQ ID NO: 18804 - RNA, 19 nt, Artificial Sequence
  Synthetic oligonucleotide
auucacaguaucaaccaau

SEQ ID NO: 18805 - RNA, 19 nt, Artificial Sequence
  Synthetic oligonucleotide
uucacaguaucaaccaaua

SEQ ID NO: 18806 - RNA, 19 nt, Artificial Sequence
  Synthetic oligonucleotide
cacaguaucaaccaauaaa

SEQ ID NO: 18807 - RNA, 19 nt, Artificial Sequence
  Synthetic oligonucleotide
acaguaucaaccaauaaaa

SEQ ID NO: 18808 - RNA, 19 nt, Artificial Sequence
  Synthetic oligonucleotide
caguaucaaccaauaaaau

SEQ ID NO: 18809 - RNA, 19 nt, Artificial Sequence
  Synthetic oligonucleotide
aguaucaaccaauaaaauu

SEQ ID NO: 18810 - RNA, 19 nt, Artificial Sequence
  Synthetic oligonucleotide
guaucaaccaauaaaauua

SEQ ID NO: 18811 - RNA, 19 nt, Artificial Sequence
  Synthetic oligonucleotide
uaucaaccaauaaaauuac

SEQ ID NO: 18812 - RNA, 19 nt, Artificial Sequence
  Synthetic oligonucleotide
aucaaccaauaaaauuaca

SEQ ID NO: 18813 - RNA, 19 nt, Artificial Sequence
  Synthetic oligonucleotide
acagcucuaauuaaagcug

SEQ ID NO: 18814 - RNA, 19 nt, Artificial Sequence
  Synthetic oligonucleotide
cagcucuaauuaaagcuga

SEQ ID NO: 18815 - RNA, 19 nt, Artificial Sequence
  Synthetic oligonucleotide
agcucuaauuaaagcugac

SEQ ID NO: 18816 - RNA, 19 nt, Artificial Sequence
  Synthetic oligonucleotide
acuuucugcuugaaaauac

SEQ ID NO: 18817 - RNA, 19 nt, Artificial Sequence
  Synthetic oligonucleotide
cuuucugcuugaaaauaca

SEQ ID NO: 18818 - RNA, 19 nt, Artificial Sequence
  Synthetic oligonucleotide
uuucugcuugaaaauacac

SEQ ID NO: 18819 - RNA, 19 nt, Artificial Sequence
  Synthetic oligonucleotide
uucugcuugaaaauacacu

SEQ ID NO: 18820 - RNA, 19 nt, Artificial Sequence
  Synthetic oligonucleotide
ucugcuugaaaauacacug

SEQ ID NO: 18821 - RNA, 19 nt, Artificial Sequence
  Synthetic oligonucleotide
cugcuugaaaauacacugc

SEQ ID NO: 18822 - RNA, 19 nt, Artificial Sequence
  Synthetic oligonucleotide
ugcuugaaaauacacugcc

SEQ ID NO: 18823 - RNA, 19 nt, Artificial Sequence
  Synthetic oligonucleotide
gcuugaaaauacacugcca

SEQ ID NO: 18824 - RNA, 19 nt, Artificial Sequence
  Synthetic oligonucleotide
cuugaaaauacacugccag

SEQ ID NO: 18825 - RNA, 19 nt, Artificial Sequence
  Synthetic oligonucleotide
uugaaaauacacugccagc

SEQ ID NO: 18826 - RNA, 19 nt, Artificial Sequence
  Synthetic oligonucleotide
ugaaaauacacugccagcc

SEQ ID NO: 18827 - RNA, 19 nt, Artificial Sequence
  Synthetic oligonucleotide
gaaaauacacugccagccc

SEQ ID NO: 18828 - RNA, 19 nt, Artificial Sequence
  Synthetic oligonucleotide
aaaauacacugccagccca

SEQ ID NO: 18829 - RNA, 19 nt, Artificial Sequence
  Synthetic oligonucleotide
aaauacacugccagcccag

SEQ ID NO: 18830 - RNA, 19 nt, Artificial Sequence
  Synthetic oligonucleotide
aauacacugccagcccaga

SEQ ID NO: 18831 - RNA, 19 nt, Artificial Sequence
  Synthetic oligonucleotide
auacacugccagcccagag

SEQ ID NO: 18832 - RNA, 19 nt, Artificial Sequence
  Synthetic oligonucleotide
uacacugccagcccagagc

SEQ ID NO: 18833 - RNA, 19 nt, Artificial Sequence
  Synthetic oligonucleotide
acacugccagcccagagca

SEQ ID NO: 18834 - RNA, 19 nt, Artificial Sequence
  Synthetic oligonucleotide
cacugccagcccagagcac

SEQ ID NO: 18835 - RNA, 19 nt, Artificial Sequence
  Synthetic oligonucleotide
acugccagcccagagcacc

SEQ ID NO: 18836 - RNA, 19 nt, Artificial Sequence
  Synthetic oligonucleotide
cugccagcccagagcaccu

SEQ ID NO: 18837 - RNA, 19 nt, Artificial Sequence
  Synthetic oligonucleotide
ugccagcccagagcaccuu

SEQ ID NO: 18838 - RNA, 19 nt, Artificial Sequence
  Synthetic oligonucleotide
gccagcccagagcaccuuu

SEQ ID NO: 18839 - RNA, 19 nt, Artificial Sequence
  Synthetic oligonucleotide
ccagcccagagcaccuuua

SEQ ID NO: 18840 - RNA, 19 nt, Artificial Sequence
  Synthetic oligonucleotide
cagcccagagcaccuuuac

SEQ ID NO: 18841 - RNA, 19 nt, Artificial Sequence
  Synthetic oligonucleotide
agcccagagcaccuuuaca

SEQ ID NO: 18842 - RNA, 19 nt, Artificial Sequence
  Synthetic oligonucleotide
gcccagagcaccuuuacau

SEQ ID NO: 18843 - RNA, 19 nt, Artificial Sequence
  Synthetic oligonucleotide
cccagagcaccuuuacauu

SEQ ID NO: 18844 - RNA, 19 nt, Artificial Sequence
  Synthetic oligonucleotide
ccagagcaccuuuacauug

SEQ ID NO: 18845 - RNA, 19 nt, Artificial Sequence
  Synthetic oligonucleotide
cagagcaccuuuacauugg

SEQ ID NO: 18846 - RNA, 19 nt, Artificial Sequence
  Synthetic oligonucleotide
agagcaccuuuacauuggc

SEQ ID NO: 18847 - RNA, 19 nt, Artificial Sequence
  Synthetic oligonucleotide
gagcaccuuuacauuggcc

SEQ ID NO: 18848 - RNA, 19 nt, Artificial Sequence
  Synthetic oligonucleotide
agcaccuuuacauuggcca

SEQ ID NO: 18849 - RNA, 19 nt, Artificial Sequence
  Synthetic oligonucleotide
gcaccuuuacauuggccau

SEQ ID NO: 18850 - RNA, 19 nt, Artificial Sequence
  Synthetic oligonucleotide
caccuuuacauuggccauu

SEQ ID NO: 18851 - RNA, 19 nt, Artificial Sequence
  Synthetic oligonucleotide
accuuuacauuggccauuu

SEQ ID NO: 18852 - RNA, 19 nt, Artificial Sequence
  Synthetic oligonucleotide
ccuuuacauuggccauuuc

SEQ ID NO: 18853 - RNA, 19 nt, Artificial Sequence
  Synthetic oligonucleotide
cuuuacauuggccauuucu

SEQ ID NO: 18854 - RNA, 19 nt, Artificial Sequence
  Synthetic oligonucleotide
uuuacauuggccauuucug

SEQ ID NO: 18855 - RNA, 19 nt, Artificial Sequence
  Synthetic oligonucleotide
guaugcucuuucccuggga

SEQ ID NO: 18856 - RNA, 19 nt, Artificial Sequence
  Synthetic oligonucleotide
uaugcucuuucccugggag

SEQ ID NO: 18857 - RNA, 19 nt, Artificial Sequence
  Synthetic oligonucleotide
augcucuuucccugggaga

SEQ ID NO: 18858 - RNA, 19 nt, Artificial Sequence
  Synthetic oligonucleotide
ugcucuuucccugggagau

SEQ ID NO: 18859 - RNA, 19 nt, Artificial Sequence
  Synthetic oligonucleotide
gcucuuucccugggagaua

SEQ ID NO: 18860 - RNA, 19 nt, Artificial Sequence
  Synthetic oligonucleotide
cucuuucccugggagauaa

SEQ ID NO: 18861 - RNA, 19 nt, Artificial Sequence
  Synthetic oligonucleotide
ucuuucccugggagauaaa

SEQ ID NO: 18862 - RNA, 19 nt, Artificial Sequence
  Synthetic oligonucleotide
cuuucccugggagauaaaa

SEQ ID NO: 18863 - RNA, 19 nt, Artificial Sequence
  Synthetic oligonucleotide
uuucccugggagauaaaac

SEQ ID NO: 18864 - RNA, 19 nt, Artificial Sequence
  Synthetic oligonucleotide
uucccugggagauaaaacu

SEQ ID NO: 18865 - RNA, 19 nt, Artificial Sequence
  Synthetic oligonucleotide
ucccugggagauaaaacuc

SEQ ID NO: 18866 - RNA, 19 nt, Artificial Sequence
  Synthetic oligonucleotide
cccugggagauaaaacuca

SEQ ID NO: 18867 - RNA, 19 nt, Artificial Sequence
  Synthetic oligonucleotide
ccugggagauaaaacucac

SEQ ID NO: 18868 - RNA, 19 nt, Artificial Sequence
  Synthetic oligonucleotide
cugggagauaaaacucacc

SEQ ID NO: 18869 - RNA, 19 nt, Artificial Sequence
  Synthetic oligonucleotide
ugggagauaaaacucaccc

SEQ ID NO: 18870 - RNA, 19 nt, Artificial Sequence
  Synthetic oligonucleotide
gggagauaaaacucaccca

SEQ ID NO: 18871 - RNA, 19 nt, Artificial Sequence
  Synthetic oligonucleotide
ggagauaaaacucacccac

SEQ ID NO: 18872 - RNA, 19 nt, Artificial Sequence
  Synthetic oligonucleotide
gagauaaaacucacccaca

SEQ ID NO: 18873 - RNA, 19 nt, Artificial Sequence
  Synthetic oligonucleotide
agauaaaacucacccacag

SEQ ID NO: 18874 - RNA, 19 nt, Artificial Sequence
  Synthetic oligonucleotide
gauaaaacucacccacagu

SEQ ID NO: 18875 - RNA, 19 nt, Artificial Sequence
  Synthetic oligonucleotide
auaaaacucacccacaguu

SEQ ID NO: 18876 - RNA, 19 nt, Artificial Sequence
  Synthetic oligonucleotide
cguucaauuguuucagcuu

SEQ ID NO: 18877 - RNA, 19 nt, Artificial Sequence
  Synthetic oligonucleotide
uucaauuguuucagcuuug

SEQ ID NO: 18878 - RNA, 19 nt, Artificial Sequence
  Synthetic oligonucleotide
ucaauuguuucagcuuuga

SEQ ID NO: 18879 - RNA, 19 nt, Artificial Sequence
  Synthetic oligonucleotide
caauuguuucagcuuugaa

SEQ ID NO: 18880 - RNA, 19 nt, Artificial Sequence
  Synthetic oligonucleotide
aauuguuucagcuuugaag

SEQ ID NO: 18881 - RNA, 19 nt, Artificial Sequence
  Synthetic oligonucleotide
auuguuucagcuuugaaga

SEQ ID NO: 18882 - RNA, 19 nt, Artificial Sequence
  Synthetic oligonucleotide
uuguuucagcuuugaagag

SEQ ID NO: 18883 - RNA, 19 nt, Artificial Sequence
  Synthetic oligonucleotide
uguuucagcuuugaagaga

SEQ ID NO: 18884 - RNA, 19 nt, Artificial Sequence
  Synthetic oligonucleotide
guuucagcuuugaagagag

SEQ ID NO: 18885 - RNA, 19 nt, Artificial Sequence
  Synthetic oligonucleotide
uuucagcuuugaagagaga

SEQ ID NO: 18886 - RNA, 19 nt, Artificial Sequence
  Synthetic oligonucleotide
uucagcuuugaagagagaa

SEQ ID NO: 18887 - RNA, 19 nt, Artificial Sequence
  Synthetic oligonucleotide
ucagcuuugaagagagaag

SEQ ID NO: 18888 - RNA, 19 nt, Artificial Sequence
  Synthetic oligonucleotide
cagcuuugaagagagaagc

SEQ ID NO: 18889 - RNA, 19 nt, Artificial Sequence
  Synthetic oligonucleotide
agcuuugaagagagaagcu

SEQ ID NO: 18890 - RNA, 19 nt, Artificial Sequence
  Synthetic oligonucleotide
gcuuugaagagagaagcuu

SEQ ID NO: 18891 - RNA, 19 nt, Artificial Sequence
  Synthetic oligonucleotide
cuuugaagagagaagcuuu

SEQ ID NO: 18892 - RNA, 19 nt, Artificial Sequence
  Synthetic oligonucleotide
uuugaagagagaagcuuug

SEQ ID NO: 18893 - RNA, 19 nt, Artificial Sequence
  Synthetic oligonucleotide
uugaagagagaagcuuugg

SEQ ID NO: 18894 - RNA, 19 nt, Artificial Sequence
  Synthetic oligonucleotide
agagagaagcuuugguuaa

SEQ ID NO: 18895 - RNA, 19 nt, Artificial Sequence
  Synthetic oligonucleotide
gagagaagcuuugguuaaa

SEQ ID NO: 18896 - RNA, 19 nt, Artificial Sequence
  Synthetic oligonucleotide
agagaagcuuugguuaaag

SEQ ID NO: 18897 - RNA, 19 nt, Artificial Sequence
  Synthetic oligonucleotide
gaagcuuugguuaaaggua

SEQ ID NO: 18898 - RNA, 19 nt, Artificial Sequence
  Synthetic oligonucleotide
aagcuuugguuaaagguaa

SEQ ID NO: 18899 - RNA, 19 nt, Artificial Sequence
  Synthetic oligonucleotide
agcuuugguuaaagguaau

SEQ ID NO: 18900 - RNA, 19 nt, Artificial Sequence
  Synthetic oligonucleotide
gcuuugguuaaagguaauc

SEQ ID NO: 18901 - RNA, 19 nt, Artificial Sequence
  Synthetic oligonucleotide
cuuugguuaaagguaaucc

SEQ ID NO: 18902 - RNA, 19 nt, Artificial Sequence
  Synthetic oligonucleotide
uuugguuaaagguaaucca

SEQ ID NO: 18903 - RNA, 19 nt, Artificial Sequence
  Synthetic oligonucleotide
uugguuaaagguaauccac

SEQ ID NO: 18904 - RNA, 19 nt, Artificial Sequence
  Synthetic oligonucleotide
ugguuaaagguaauccacc

SEQ ID NO: 18905 - RNA, 19 nt, Artificial Sequence
  Synthetic oligonucleotide
gguuaaagguaauccaccc

SEQ ID NO: 18906 - RNA, 19 nt, Artificial Sequence
  Synthetic oligonucleotide
guuaaagguaauccaccca

SEQ ID NO: 18907 - RNA, 19 nt, Artificial Sequence
  Synthetic oligonucleotide
uuaaagguaauccacccau

SEQ ID NO: 18908 - RNA, 19 nt, Artificial Sequence
  Synthetic oligonucleotide
uaaagguaauccacccauu

SEQ ID NO: 18909 - RNA, 19 nt, Artificial Sequence
  Synthetic oligonucleotide
aaagguaauccacccauuu

SEQ ID NO: 18910 - RNA, 19 nt, Artificial Sequence
  Synthetic oligonucleotide
aagguaauccacccauuua

SEQ ID NO: 18911 - RNA, 19 nt, Artificial Sequence
  Synthetic oligonucleotide
agguaauccacccauuuau

SEQ ID NO: 18912 - RNA, 19 nt, Artificial Sequence
  Synthetic oligonucleotide
gguaauccacccauuuauc

SEQ ID NO: 18913 - RNA, 19 nt, Artificial Sequence
  Synthetic oligonucleotide
guaauccacccauuuaucg

SEQ ID NO: 18914 - RNA, 19 nt, Artificial Sequence
  Synthetic oligonucleotide
uaauccacccauuuaucgu

SEQ ID NO: 18915 - RNA, 19 nt, Artificial Sequence
  Synthetic oligonucleotide
aauccacccauuuaucguu

SEQ ID NO: 18916 - RNA, 19 nt, Artificial Sequence
  Synthetic oligonucleotide
auccacccauuuaucguuu

SEQ ID NO: 18917 - RNA, 19 nt, Artificial Sequence
  Synthetic oligonucleotide
uccacccauuuaucguuuu

SEQ ID NO: 18918 - RNA, 19 nt, Artificial Sequence
  Synthetic oligonucleotide
ccacccauuuaucguuuuu

SEQ ID NO: 18919 - RNA, 19 nt, Artificial Sequence
  Synthetic oligonucleotide
cacccauuuaucguuuuug

SEQ ID NO: 18920 - RNA, 19 nt, Artificial Sequence
  Synthetic oligonucleotide
acccauuuaucguuuuugg

SEQ ID NO: 18921 - RNA, 19 nt, Artificial Sequence
  Synthetic oligonucleotide
ccauuuaucguuuuuggaa

SEQ ID NO: 18922 - RNA, 19 nt, Artificial Sequence
  Synthetic oligonucleotide
cauuuaucguuuuuggaaa

SEQ ID NO: 18923 - RNA, 19 nt, Artificial Sequence
  Synthetic oligonucleotide
auuuaucguuuuuggaaag

SEQ ID NO: 18924 - RNA, 19 nt, Artificial Sequence
  Synthetic oligonucleotide
uuuaucguuuuuggaaaga

SEQ ID NO: 18925 - RNA, 19 nt, Artificial Sequence
  Synthetic oligonucleotide
uuaucguuuuuggaaagac

SEQ ID NO: 18926 - RNA, 19 nt, Artificial Sequence
  Synthetic oligonucleotide
gcauaaagacagcucugua

SEQ ID NO: 18927 - RNA, 19 nt, Artificial Sequence
  Synthetic oligonucleotide
cauaaagacagcucuguac

SEQ ID NO: 18928 - RNA, 19 nt, Artificial Sequence
  Synthetic oligonucleotide
auaaagacagcucuguacc

SEQ ID NO: 18929 - RNA, 19 nt, Artificial Sequence
  Synthetic oligonucleotide
uaaagacagcucuguaccu

SEQ ID NO: 18930 - RNA, 19 nt, Artificial Sequence
  Synthetic oligonucleotide
aaagacagcucuguaccua

SEQ ID NO: 18931 - RNA, 19 nt, Artificial Sequence
  Synthetic oligonucleotide
aagacagcucuguaccuaa

SEQ ID NO: 18932 - RNA, 19 nt, Artificial Sequence
  Synthetic oligonucleotide
agacagcucuguaccuaac

SEQ ID NO: 18933 - RNA, 19 nt, Artificial Sequence
  Synthetic oligonucleotide
gacagcucuguaccuaaca

SEQ ID NO: 18934 - RNA, 19 nt, Artificial Sequence
  Synthetic oligonucleotide
acagcucuguaccuaacac

SEQ ID NO: 18935 - RNA, 19 nt, Artificial Sequence
  Synthetic oligonucleotide
cagcucuguaccuaacacu

SEQ ID NO: 18936 - RNA, 19 nt, Artificial Sequence
  Synthetic oligonucleotide
agcucuguaccuaacacug

SEQ ID NO: 18937 - RNA, 19 nt, Artificial Sequence
  Synthetic oligonucleotide
gcucuguaccuaacacugg

SEQ ID NO: 18938 - RNA, 19 nt, Artificial Sequence
  Synthetic oligonucleotide
cucuguaccuaacacuggu

SEQ ID NO: 18939 - RNA, 19 nt, Artificial Sequence
  Synthetic oligonucleotide
ucuguaccuaacacuggua

SEQ ID NO: 18940 - RNA, 19 nt, Artificial Sequence
  Synthetic oligonucleotide
ggcacguaugguagaaaca

SEQ ID NO: 18941 - RNA, 19 nt, Artificial Sequence
  Synthetic oligonucleotide
gcacguaugguagaaacaa

SEQ ID NO: 18942 - RNA, 19 nt, Artificial Sequence
  Synthetic oligonucleotide
cacguaugguagaaacaac

SEQ ID NO: 18943 - RNA, 19 nt, Artificial Sequence
  Synthetic oligonucleotide
acguaugguagaaacaacu

SEQ ID NO: 18944 - RNA, 19 nt, Artificial Sequence
  Synthetic oligonucleotide
cguaugguagaaacaacug

SEQ ID NO: 18945 - RNA, 19 nt, Artificial Sequence
  Synthetic oligonucleotide
guaugguagaaacaacugc

SEQ ID NO: 18946 - RNA, 19 nt, Artificial Sequence
  Synthetic oligonucleotide
uaugguagaaacaacugcc

SEQ ID NO: 18947 - RNA, 19 nt, Artificial Sequence
  Synthetic oligonucleotide
augguagaaacaacugccu

SEQ ID NO: 18948 - RNA, 19 nt, Artificial Sequence
  Synthetic oligonucleotide
ugguagaaacaacugccua

SEQ ID NO: 18949 - RNA, 19 nt, Artificial Sequence
  Synthetic oligonucleotide
gguagaaacaacugccuau

SEQ ID NO: 18950 - RNA, 19 nt, Artificial Sequence
  Synthetic oligonucleotide
guagaaacaacugccuaug

SEQ ID NO: 18951 - RNA, 19 nt, Artificial Sequence
  Synthetic oligonucleotide
uagaaacaacugccuaugc

SEQ ID NO: 18952 - RNA, 19 nt, Artificial Sequence
  Synthetic oligonucleotide
agaaacaacugccuaugcu

SEQ ID NO: 18953 - RNA, 19 nt, Artificial Sequence
  Synthetic oligonucleotide
gaaacaacugccuaugcuu

SEQ ID NO: 18954 - RNA, 19 nt, Artificial Sequence
  Synthetic oligonucleotide
aaacaacugccuaugcuuu

SEQ ID NO: 18955 - RNA, 19 nt, Artificial Sequence
  Synthetic oligonucleotide
aacaacugccuaugcuuua

SEQ ID NO: 18956 - RNA, 19 nt, Artificial Sequence
  Synthetic oligonucleotide
acaacugccuaugcuuuac

SEQ ID NO: 18957 - RNA, 19 nt, Artificial Sequence
  Synthetic oligonucleotide
caacugccuaugcuuuacu

SEQ ID NO: 18958 - RNA, 19 nt, Artificial Sequence
  Synthetic oligonucleotide
aacugccuaugcuuuacuc

SEQ ID NO: 18959 - RNA, 19 nt, Artificial Sequence
  Synthetic oligonucleotide
acugccuaugcuuuacuca

SEQ ID NO: 18960 - RNA, 19 nt, Artificial Sequence
  Synthetic oligonucleotide
cugccuaugcuuuacucac

SEQ ID NO: 18961 - RNA, 19 nt, Artificial Sequence
  Synthetic oligonucleotide
ugccuaugcuuuacucacc

SEQ ID NO: 18962 - RNA, 19 nt, Artificial Sequence
  Synthetic oligonucleotide
gccuaugcuuuacucacca

SEQ ID NO: 18963 - RNA, 19 nt, Artificial Sequence
  Synthetic oligonucleotide
ccuaugcuuuacucaccag

SEQ ID NO: 18964 - RNA, 19 nt, Artificial Sequence
  Synthetic oligonucleotide
cuaugcuuuacucaccagu

SEQ ID NO: 18965 - RNA, 19 nt, Artificial Sequence
  Synthetic oligonucleotide
uaugcuuuacucaccaguc

SEQ ID NO: 18966 - RNA, 19 nt, Artificial Sequence
  Synthetic oligonucleotide
augcuuuacucaccagucu

SEQ ID NO: 18967 - RNA, 19 nt, Artificial Sequence
  Synthetic oligonucleotide
cuuuacucaccagucugaa

SEQ ID NO: 18968 - RNA, 19 nt, Artificial Sequence
  Synthetic oligonucleotide
uuuacucaccagucugaac

SEQ ID NO: 18969 - RNA, 19 nt, Artificial Sequence
  Synthetic oligonucleotide
uuacucaccagucugaacu

SEQ ID NO: 18970 - RNA, 19 nt, Artificial Sequence
  Synthetic oligonucleotide
uacucaccagucugaacuu

SEQ ID NO: 18971 - RNA, 19 nt, Artificial Sequence
  Synthetic oligonucleotide
cucaccagucugaacuuga

SEQ ID NO: 18972 - RNA, 19 nt, Artificial Sequence
  Synthetic oligonucleotide
ucaccagucugaacuugaa

SEQ ID NO: 18973 - RNA, 19 nt, Artificial Sequence
  Synthetic oligonucleotide
caccagucugaacuugaaa

SEQ ID NO: 18974 - RNA, 19 nt, Artificial Sequence
  Synthetic oligonucleotide
gucaucaaauggcuaucag

SEQ ID NO: 18975 - RNA, 19 nt, Artificial Sequence
  Synthetic oligonucleotide
ucaucaaauggcuaucaga

SEQ ID NO: 18976 - RNA, 19 nt, Artificial Sequence
  Synthetic oligonucleotide
caucaaauggcuaucagaa

SEQ ID NO: 18977 - RNA, 19 nt, Artificial Sequence
  Synthetic oligonucleotide
aucaaauggcuaucagaag

SEQ ID NO: 18978 - RNA, 19 nt, Artificial Sequence
  Synthetic oligonucleotide
ucaaauggcuaucagaaga

SEQ ID NO: 18979 - RNA, 19 nt, Artificial Sequence
  Synthetic oligonucleotide
caaauggcuaucagaagag

SEQ ID NO: 18980 - RNA, 19 nt, Artificial Sequence
  Synthetic oligonucleotide
aaauggcuaucagaagagc

SEQ ID NO: 18981 - RNA, 19 nt, Artificial Sequence
  Synthetic oligonucleotide
aauggcuaucagaagagca

SEQ ID NO: 18982 - RNA, 19 nt, Artificial Sequence
  Synthetic oligonucleotide
auggcuaucagaagagcag

SEQ ID NO: 18983 - RNA, 19 nt, Artificial Sequence
  Synthetic oligonucleotide
uggcuaucagaagagcaga

SEQ ID NO: 18984 - RNA, 19 nt, Artificial Sequence
  Synthetic oligonucleotide
ggcuaucagaagagcagag

SEQ ID NO: 18985 - RNA, 19 nt, Artificial Sequence
  Synthetic oligonucleotide
gcuaucagaagagcagagg

SEQ ID NO: 18986 - RNA, 19 nt, Artificial Sequence
  Synthetic oligonucleotide
cuaucagaagagcagaggu

SEQ ID NO: 18987 - RNA, 19 nt, Artificial Sequence
  Synthetic oligonucleotide
uaucagaagagcagaggua

SEQ ID NO: 18988 - RNA, 19 nt, Artificial Sequence
  Synthetic oligonucleotide
aucagaagagcagagguau

SEQ ID NO: 18989 - RNA, 19 nt, Artificial Sequence
  Synthetic oligonucleotide
ucagaagagcagagguaug

SEQ ID NO: 18990 - RNA, 19 nt, Artificial Sequence
  Synthetic oligonucleotide
cagaagagcagagguaugg

SEQ ID NO: 18991 - RNA, 19 nt, Artificial Sequence
  Synthetic oligonucleotide
aagagcagagguauggagg

SEQ ID NO: 18992 - RNA, 19 nt, Artificial Sequence
  Synthetic oligonucleotide
agagcagagguauggaggu

SEQ ID NO: 18993 - RNA, 19 nt, Artificial Sequence
  Synthetic oligonucleotide
gagcagagguauggaggug

SEQ ID NO: 18994 - RNA, 19 nt, Artificial Sequence
  Synthetic oligonucleotide
agcagagguauggaggugg

SEQ ID NO: 18995 - RNA, 19 nt, Artificial Sequence
  Synthetic oligonucleotide
gcagagguauggagguggc

SEQ ID NO: 18996 - RNA, 19 nt, Artificial Sequence
  Synthetic oligonucleotide
cagagguauggagguggcu

SEQ ID NO: 18997 - RNA, 19 nt, Artificial Sequence
  Synthetic oligonucleotide
agagguauggagguggcuu

SEQ ID NO: 18998 - RNA, 19 nt, Artificial Sequence
  Synthetic oligonucleotide
gagguauggagguggcuuu

SEQ ID NO: 18999 - RNA, 19 nt, Artificial Sequence
  Synthetic oligonucleotide
agguauggagguggcuuuu

SEQ ID NO: 19000 - RNA, 19 nt, Artificial Sequence
  Synthetic oligonucleotide
gguauggagguggcuuuua

SEQ ID NO: 19001 - RNA, 19 nt, Artificial Sequence
  Synthetic oligonucleotide
guauggagguggcuuuuau

SEQ ID NO: 19002 - RNA, 19 nt, Artificial Sequence
  Synthetic oligonucleotide
uauggagguggcuuuuauu

SEQ ID NO: 19003 - RNA, 19 nt, Artificial Sequence
  Synthetic oligonucleotide
auggagguggcuuuuauuc

SEQ ID NO: 19004 - RNA, 19 nt, Artificial Sequence
  Synthetic oligonucleotide
uggagguggcuuuuauuca

SEQ ID NO: 19005 - RNA, 19 nt, Artificial Sequence
  Synthetic oligonucleotide
ggagguggcuuuuauucaa

SEQ ID NO: 19006 - RNA, 19 nt, Artificial Sequence
  Synthetic oligonucleotide
gagguggcuuuuauucaac

SEQ ID NO: 19007 - RNA, 19 nt, Artificial Sequence
  Synthetic oligonucleotide
agguggcuuuuauucaacc

SEQ ID NO: 19008 - RNA, 19 nt, Artificial Sequence
  Synthetic oligonucleotide
gguggcuuuuauucaaccc

SEQ ID NO: 19009 - RNA, 19 nt, Artificial Sequence
  Synthetic oligonucleotide
gaauauucacuccugguua

SEQ ID NO: 19010 - RNA, 19 nt, Artificial Sequence
  Synthetic oligonucleotide
aauauucacuccugguuaa

SEQ ID NO: 19011 - RNA, 19 nt, Artificial Sequence
  Synthetic oligonucleotide
auauucacuccugguuaaa

SEQ ID NO: 19012 - RNA, 19 nt, Artificial Sequence
  Synthetic oligonucleotide
uauucacuccugguuaaac

SEQ ID NO: 19013 - RNA, 19 nt, Artificial Sequence
  Synthetic oligonucleotide
ccuuacauaauuauaaaau

SEQ ID NO: 19014 - RNA, 19 nt, Artificial Sequence
  Synthetic oligonucleotide
cuuacauaauuauaaaaug

SEQ ID NO: 19015 - RNA, 19 nt, Artificial Sequence
  Synthetic oligonucleotide
uuacauaauuauaaaauga

SEQ ID NO: 19016 - RNA, 19 nt, Artificial Sequence
  Synthetic oligonucleotide
uacauaauuauaaaaugac

SEQ ID NO: 19017 - RNA, 19 nt, Artificial Sequence
  Synthetic oligonucleotide
acauaauuauaaaaugaca

SEQ ID NO: 19018 - RNA, 19 nt, Artificial Sequence
  Synthetic oligonucleotide
cauaauuauaaaaugacag

SEQ ID NO: 19019 - RNA, 19 nt, Artificial Sequence
  Synthetic oligonucleotide
auaauuauaaaaugacaga

SEQ ID NO: 19020 - RNA, 19 nt, Artificial Sequence
  Synthetic oligonucleotide
uaauuauaaaaugacagac

SEQ ID NO: 19021 - RNA, 19 nt, Artificial Sequence
  Synthetic oligonucleotide
aauuauaaaaugacagaca

SEQ ID NO: 19022 - RNA, 19 nt, Artificial Sequence
  Synthetic oligonucleotide
auuauaaaaugacagacaa

SEQ ID NO: 19023 - RNA, 19 nt, Artificial Sequence
  Synthetic oligonucleotide
uuauaaaaugacagacaag

SEQ ID NO: 19024 - RNA, 19 nt, Artificial Sequence
  Synthetic oligonucleotide
uauaaaaugacagacaaga

SEQ ID NO: 19025 - RNA, 19 nt, Artificial Sequence
  Synthetic oligonucleotide
auaaaaugacagacaagaa

SEQ ID NO: 19026 - RNA, 19 nt, Artificial Sequence
  Synthetic oligonucleotide
uaaaaugacagacaagaau

SEQ ID NO: 19027 - RNA, 19 nt, Artificial Sequence
  Synthetic oligonucleotide
aaaaugacagacaagaauu

SEQ ID NO: 19028 - RNA, 19 nt, Artificial Sequence
  Synthetic oligonucleotide
aaaugacagacaagaauuu

SEQ ID NO: 19029 - RNA, 19 nt, Artificial Sequence
  Synthetic oligonucleotide
aaugacagacaagaauuuc

SEQ ID NO: 19030 - RNA, 19 nt, Artificial Sequence
  Synthetic oligonucleotide
augacagacaagaauuucc

SEQ ID NO: 19031 - RNA, 19 nt, Artificial Sequence
  Synthetic oligonucleotide
ugacagacaagaauuuccu

SEQ ID NO: 19032 - RNA, 19 nt, Artificial Sequence
  Synthetic oligonucleotide
gacagacaagaauuuccuu

SEQ ID NO: 19033 - RNA, 19 nt, Artificial Sequence
  Synthetic oligonucleotide
acagacaagaauuuccuug

SEQ ID NO: 19034 - RNA, 19 nt, Artificial Sequence
  Synthetic oligonucleotide
cagacaagaauuuccuugg

SEQ ID NO: 19035 - RNA, 19 nt, Artificial Sequence
  Synthetic oligonucleotide
agacaagaauuuccuuggg

SEQ ID NO: 19036 - RNA, 19 nt, Artificial Sequence
  Synthetic oligonucleotide
gacaagaauuuccuuggga

SEQ ID NO: 19037 - RNA, 19 nt, Artificial Sequence
  Synthetic oligonucleotide
acaagaauuuccuugggag

SEQ ID NO: 19038 - RNA, 19 nt, Artificial Sequence
  Synthetic oligonucleotide
caagaauuuccuugggagg

SEQ ID NO: 19039 - RNA, 19 nt, Artificial Sequence
  Synthetic oligonucleotide
aagaauuuccuugggaggc

SEQ ID NO: 19040 - RNA, 19 nt, Artificial Sequence
  Synthetic oligonucleotide
agaauuuccuugggaggcc

SEQ ID NO: 19041 - RNA, 19 nt, Artificial Sequence
  Synthetic oligonucleotide
ccuugggaggccaguagag

SEQ ID NO: 19042 - RNA, 19 nt, Artificial Sequence
  Synthetic oligonucleotide
ugggaggccaguagaggug

SEQ ID NO: 19043 - RNA, 19 nt, Artificial Sequence
  Synthetic oligonucleotide
gggaggccaguagaggugc

SEQ ID NO: 19044 - RNA, 19 nt, Artificial Sequence
  Synthetic oligonucleotide
ggaggccaguagaggugcu

SEQ ID NO: 19045 - RNA, 19 nt, Artificial Sequence
  Synthetic oligonucleotide
gaggccaguagaggugcuu

SEQ ID NO: 19046 - RNA, 19 nt, Artificial Sequence
  Synthetic oligonucleotide
aggccaguagaggugcuuc

SEQ ID NO: 19047 - RNA, 19 nt, Artificial Sequence
  Synthetic oligonucleotide
ggccaguagaggugcuucu

SEQ ID NO: 19048 - RNA, 19 nt, Artificial Sequence
  Synthetic oligonucleotide
gccaguagaggugcuucuc

SEQ ID NO: 19049 - RNA, 19 nt, Artificial Sequence
  Synthetic oligonucleotide
ccaguagaggugcuucuca

SEQ ID NO: 19050 - RNA, 19 nt, Artificial Sequence
  Synthetic oligonucleotide
caguagaggugcuucucaa

SEQ ID NO: 19051 - RNA, 19 nt, Artificial Sequence
  Synthetic oligonucleotide
aguagaggugcuucucaau

SEQ ID NO: 19052 - RNA, 19 nt, Artificial Sequence
  Synthetic oligonucleotide
guagaggugcuucucaaug

SEQ ID NO: 19053 - RNA, 19 nt, Artificial Sequence
  Synthetic oligonucleotide
uagaggugcuucucaauga

SEQ ID NO: 19054 - RNA, 19 nt, Artificial Sequence
  Synthetic oligonucleotide
agaggugcuucucaaugau

SEQ ID NO: 19055 - RNA, 19 nt, Artificial Sequence
  Synthetic oligonucleotide
gaggugcuucucaaugaug

SEQ ID NO: 19056 - RNA, 19 nt, Artificial Sequence
  Synthetic oligonucleotide
aggugcuucucaaugauga

SEQ ID NO: 19057 - RNA, 19 nt, Artificial Sequence
  Synthetic oligonucleotide
ggugcuucucaaugaugac

SEQ ID NO: 19058 - RNA, 19 nt, Artificial Sequence
  Synthetic oligonucleotide
gugcuucucaaugaugacc

SEQ ID NO: 19059 - RNA, 19 nt, Artificial Sequence
  Synthetic oligonucleotide
ugcuucucaaugaugaccu

SEQ ID NO: 19060 - RNA, 19 nt, Artificial Sequence
  Synthetic oligonucleotide
auugucaguacaggauuug

SEQ ID NO: 19061 - RNA, 19 nt, Artificial Sequence
  Synthetic oligonucleotide
uugucaguacaggauuugg

SEQ ID NO: 19062 - RNA, 19 nt, Artificial Sequence
  Synthetic oligonucleotide
ugucaguacaggauuuggc

SEQ ID NO: 19063 - RNA, 19 nt, Artificial Sequence
  Synthetic oligonucleotide
gucaguacaggauuuggca

SEQ ID NO: 19064 - RNA, 19 nt, Artificial Sequence
  Synthetic oligonucleotide
ucaguacaggauuuggcag

SEQ ID NO: 19065 - RNA, 19 nt, Artificial Sequence
  Synthetic oligonucleotide
caguacaggauuuggcagu

SEQ ID NO: 19066 - RNA, 19 nt, Artificial Sequence
  Synthetic oligonucleotide
aguacaggauuuggcagug

SEQ ID NO: 19067 - RNA, 19 nt, Artificial Sequence
  Synthetic oligonucleotide
guacaggauuuggcagugg

SEQ ID NO: 19068 - RNA, 19 nt, Artificial Sequence
  Synthetic oligonucleotide
uacaggauuuggcaguggc

SEQ ID NO: 19069 - RNA, 19 nt, Artificial Sequence
  Synthetic oligonucleotide
acaggauuuggcaguggcu

SEQ ID NO: 19070 - RNA, 19 nt, Artificial Sequence
  Synthetic oligonucleotide
caggauuuggcaguggcuu

SEQ ID NO: 19071 - RNA, 19 nt, Artificial Sequence
  Synthetic oligonucleotide
ggauuuggcaguggcuugg

SEQ ID NO: 19072 - RNA, 19 nt, Artificial Sequence
  Synthetic oligonucleotide
gauuuggcaguggcuuggc

SEQ ID NO: 19073 - RNA, 19 nt, Artificial Sequence
  Synthetic oligonucleotide
auuuggcaguggcuuggcu

SEQ ID NO: 19074 - RNA, 19 nt, Artificial Sequence
  Synthetic oligonucleotide
uuuggcaguggcuuggcua

SEQ ID NO: 19075 - RNA, 19 nt, Artificial Sequence
  Synthetic oligonucleotide
aguacauguaacaacugua

SEQ ID NO: 19076 - RNA, 19 nt, Artificial Sequence
  Synthetic oligonucleotide
guacauguaacaacuguag

SEQ ID NO: 19077 - RNA, 19 nt, Artificial Sequence
  Synthetic oligonucleotide
uacauguaacaacuguagu

SEQ ID NO: 19078 - RNA, 19 nt, Artificial Sequence
  Synthetic oligonucleotide
cauguaacaacuguaguuc

SEQ ID NO: 19079 - RNA, 19 nt, Artificial Sequence
  Synthetic oligonucleotide
auguaacaacuguaguuca

SEQ ID NO: 19080 - RNA, 19 nt, Artificial Sequence
  Synthetic oligonucleotide
uguaacaacuguaguucac

SEQ ID NO: 19081 - RNA, 19 nt, Artificial Sequence
  Synthetic oligonucleotide
guaacaacuguaguucaca

SEQ ID NO: 19082 - RNA, 19 nt, Artificial Sequence
  Synthetic oligonucleotide
uaacaacuguaguucacaa

SEQ ID NO: 19083 - RNA, 19 nt, Artificial Sequence
  Synthetic oligonucleotide
aacaacuguaguucacaaa

SEQ ID NO: 19084 - RNA, 19 nt, Artificial Sequence
  Synthetic oligonucleotide
acaacuguaguucacaaaa

SEQ ID NO: 19085 - RNA, 19 nt, Artificial Sequence
  Synthetic oligonucleotide
caacuguaguucacaaaac

SEQ ID NO: 19086 - RNA, 19 nt, Artificial Sequence
  Synthetic oligonucleotide
aacuguaguucacaaaacc

SEQ ID NO: 19087 - RNA, 19 nt, Artificial Sequence
  Synthetic oligonucleotide
acuguaguucacaaaacca

SEQ ID NO: 19088 - RNA, 19 nt, Artificial Sequence
  Synthetic oligonucleotide
cuguaguucacaaaaccag

SEQ ID NO: 19089 - RNA, 19 nt, Artificial Sequence
  Synthetic oligonucleotide
uguaguucacaaaaccagu

SEQ ID NO: 19090 - RNA, 19 nt, Artificial Sequence
  Synthetic oligonucleotide
guaguucacaaaaccagua

SEQ ID NO: 19091 - RNA, 19 nt, Artificial Sequence
  Synthetic oligonucleotide
uaguucacaaaaccaguac

SEQ ID NO: 19092 - RNA, 19 nt, Artificial Sequence
  Synthetic oligonucleotide
aguucacaaaaccaguacc

SEQ ID NO: 19093 - RNA, 19 nt, Artificial Sequence
  Synthetic oligonucleotide
guucacaaaaccaguaccu

SEQ ID NO: 19094 - RNA, 19 nt, Artificial Sequence
  Synthetic oligonucleotide
uucacaaaaccaguaccuc

SEQ ID NO: 19095 - RNA, 19 nt, Artificial Sequence
  Synthetic oligonucleotide
ucacaaaaccaguaccucu

SEQ ID NO: 19096 - RNA, 19 nt, Artificial Sequence
  Synthetic oligonucleotide
cacaaaaccaguaccucug

SEQ ID NO: 19097 - RNA, 19 nt, Artificial Sequence
  Synthetic oligonucleotide
acaaaaccaguaccucuga

SEQ ID NO: 19098 - RNA, 19 nt, Artificial Sequence
  Synthetic oligonucleotide
caaaaccaguaccucugag

SEQ ID NO: 19099 - RNA, 19 nt, Artificial Sequence
  Synthetic oligonucleotide
aaaaccaguaccucugagg

SEQ ID NO: 19100 - RNA, 19 nt, Artificial Sequence
  Synthetic oligonucleotide
aaaccaguaccucugagga

SEQ ID NO: 19101 - RNA, 19 nt, Artificial Sequence
  Synthetic oligonucleotide
aaccaguaccucugaggaa

SEQ ID NO: 19102 - RNA, 19 nt, Artificial Sequence
  Synthetic oligonucleotide
accaguaccucugaggaag

SEQ ID NO: 19103 - RNA, 19 nt, Artificial Sequence
  Synthetic oligonucleotide
ccaguaccucugaggaagu

SEQ ID NO: 19104 - RNA, 19 nt, Artificial Sequence
  Synthetic oligonucleotide
caguaccucugaggaaguu

SEQ ID NO: 19105 - RNA, 19 nt, Artificial Sequence
  Synthetic oligonucleotide
aguaccucugaggaaguuu

SEQ ID NO: 19106 - RNA, 19 nt, Artificial Sequence
  Synthetic oligonucleotide
guaccucugaggaaguuug

SEQ ID NO: 19107 - RNA, 19 nt, Artificial Sequence
  Synthetic oligonucleotide
uaccucugaggaaguuugc

SEQ ID NO: 19108 - RNA, 19 nt, Artificial Sequence
  Synthetic oligonucleotide
accucugaggaaguuugca

SEQ ID NO: 19109 - RNA, 19 nt, Artificial Sequence
  Synthetic oligonucleotide
ccucugaggaaguuugcag

SEQ ID NO: 19110 - RNA, 19 nt, Artificial Sequence
  Synthetic oligonucleotide
cucugaggaaguuugcagc

SEQ ID NO: 19111 - RNA, 19 nt, Artificial Sequence
  Synthetic oligonucleotide
ucugaggaaguuugcagcu

SEQ ID NO: 19112 - RNA, 19 nt, Artificial Sequence
  Synthetic oligonucleotide
cugaggaaguuugcagcuu

SEQ ID NO: 19113 - RNA, 19 nt, Artificial Sequence
  Synthetic oligonucleotide
uuugcagcuuuuauuugaa

SEQ ID NO: 19114 - RNA, 19 nt, Artificial Sequence
  Synthetic oligonucleotide
uugcagcuuuuauuugaaa

SEQ ID NO: 19115 - RNA, 19 nt, Artificial Sequence
  Synthetic oligonucleotide
cgauacucaggauauugaa

SEQ ID NO: 19116 - RNA, 19 nt, Artificial Sequence
  Synthetic oligonucleotide
auacucaggauauugaagc

SEQ ID NO: 19117 - RNA, 19 nt, Artificial Sequence
  Synthetic oligonucleotide
uacucaggauauugaagca

SEQ ID NO: 19118 - RNA, 19 nt, Artificial Sequence
  Synthetic oligonucleotide
acucaggauauugaagcau

SEQ ID NO: 19119 - RNA, 19 nt, Artificial Sequence
  Synthetic oligonucleotide
cucaggauauugaagcauc

SEQ ID NO: 19120 - RNA, 19 nt, Artificial Sequence
  Synthetic oligonucleotide
caggauauugaagcauccc

SEQ ID NO: 19121 - RNA, 19 nt, Artificial Sequence
  Synthetic oligonucleotide
aggauauugaagcauccca

SEQ ID NO: 19122 - RNA, 19 nt, Artificial Sequence
  Synthetic oligonucleotide
ggauauugaagcaucccac

SEQ ID NO: 19123 - RNA, 19 nt, Artificial Sequence
  Synthetic oligonucleotide
gauauugaagcaucccacu

SEQ ID NO: 19124 - RNA, 19 nt, Artificial Sequence
  Synthetic oligonucleotide
auauugaagcaucccacua

SEQ ID NO: 19125 - RNA, 19 nt, Artificial Sequence
  Synthetic oligonucleotide
uauugaagcaucccacuac

SEQ ID NO: 19126 - RNA, 19 nt, Artificial Sequence
  Synthetic oligonucleotide
auugaagcaucccacuaca

SEQ ID NO: 19127 - RNA, 19 nt, Artificial Sequence
  Synthetic oligonucleotide
uugaagcaucccacuacag

SEQ ID NO: 19128 - RNA, 19 nt, Artificial Sequence
  Synthetic oligonucleotide
ugaagcaucccacuacaga

SEQ ID NO: 19129 - RNA, 19 nt, Artificial Sequence
  Synthetic oligonucleotide
gaagcaucccacuacagag

SEQ ID NO: 19130 - RNA, 19 nt, Artificial Sequence
  Synthetic oligonucleotide
aagcaucccacuacagagg

SEQ ID NO: 19131 - RNA, 19 nt, Artificial Sequence
  Synthetic oligonucleotide
agcaucccacuacagaggc

SEQ ID NO: 19132 - RNA, 19 nt, Artificial Sequence
  Synthetic oligonucleotide
gcaucccacuacagaggcu

SEQ ID NO: 19133 - RNA, 19 nt, Artificial Sequence
  Synthetic oligonucleotide
caucccacuacagaggcua

SEQ ID NO: 19134 - RNA, 19 nt, Artificial Sequence
  Synthetic oligonucleotide
aucccacuacagaggcuac

SEQ ID NO: 19135 - RNA, 19 nt, Artificial Sequence
  Synthetic oligonucleotide
ucccacuacagaggcuacg

SEQ ID NO: 19136 - RNA, 19 nt, Artificial Sequence
  Synthetic oligonucleotide
cccacuacagaggcuacgg

SEQ ID NO: 19137 - RNA, 19 nt, Artificial Sequence
  Synthetic oligonucleotide
ccacuacagaggcuacgga

SEQ ID NO: 19138 - RNA, 19 nt, Artificial Sequence
  Synthetic oligonucleotide
cacuacagaggcuacggaa

SEQ ID NO: 19139 - RNA, 19 nt, Artificial Sequence
  Synthetic oligonucleotide
acuacagaggcuacggaaa

SEQ ID NO: 19140 - RNA, 19 nt, Artificial Sequence
  Synthetic oligonucleotide
cuacagaggcuacggaaac

SEQ ID NO: 19141 - RNA, 19 nt, Artificial Sequence
  Synthetic oligonucleotide
uacagaggcuacggaaacu

SEQ ID NO: 19142 - RNA, 19 nt, Artificial Sequence
  Synthetic oligonucleotide
acagaggcuacggaaacuc

SEQ ID NO: 19143 - RNA, 19 nt, Artificial Sequence
  Synthetic oligonucleotide
cagaggcuacggaaacucu

SEQ ID NO: 19144 - RNA, 19 nt, Artificial Sequence
  Synthetic oligonucleotide
agaggcuacggaaacucug

SEQ ID NO: 19145 - RNA, 19 nt, Artificial Sequence
  Synthetic oligonucleotide
gaggcuacggaaacucuga

SEQ ID NO: 19146 - RNA, 19 nt, Artificial Sequence
  Synthetic oligonucleotide
aggcuacggaaacucugau

SEQ ID NO: 19147 - RNA, 19 nt, Artificial Sequence
  Synthetic oligonucleotide
ggcuacggaaacucugauu

SEQ ID NO: 19148 - RNA, 19 nt, Artificial Sequence
  Synthetic oligonucleotide
gcuacggaaacucugauua

SEQ ID NO: 19149 - RNA, 19 nt, Artificial Sequence
  Synthetic oligonucleotide
cuacggaaacucugauuac

SEQ ID NO: 19150 - RNA, 19 nt, Artificial Sequence
  Synthetic oligonucleotide
uacggaaacucugauuaca

SEQ ID NO: 19151 - RNA, 19 nt, Artificial Sequence
  Synthetic oligonucleotide
acggaaacucugauuacaa

SEQ ID NO: 19152 - RNA, 19 nt, Artificial Sequence
  Synthetic oligonucleotide
cggaaacucugauuacaaa

SEQ ID NO: 19153 - RNA, 19 nt, Artificial Sequence
  Synthetic oligonucleotide
ggaaacucugauuacaaac

SEQ ID NO: 19154 - RNA, 19 nt, Artificial Sequence
  Synthetic oligonucleotide
gaaacucugauuacaaacg

SEQ ID NO: 19155 - RNA, 19 nt, Artificial Sequence
  Synthetic oligonucleotide
aaacucugauuacaaacgc

SEQ ID NO: 19156 - RNA, 19 nt, Artificial Sequence
  Synthetic oligonucleotide
aacucugauuacaaacgca

SEQ ID NO: 19157 - RNA, 19 nt, Artificial Sequence
  Synthetic oligonucleotide
acucugauuacaaacgcau

SEQ ID NO: 19158 - RNA, 19 nt, Artificial Sequence
  Synthetic oligonucleotide
cucugauuacaaacgcaua

SEQ ID NO: 19159 - RNA, 19 nt, Artificial Sequence
  Synthetic oligonucleotide
ucugauuacaaacgcauag

SEQ ID NO: 19160 - RNA, 19 nt, Artificial Sequence
  Synthetic oligonucleotide
cugauuacaaacgcauagu

SEQ ID NO: 19161 - RNA, 19 nt, Artificial Sequence
  Synthetic oligonucleotide
ugauuacaaacgcauagua

SEQ ID NO: 19162 - RNA, 19 nt, Artificial Sequence
  Synthetic oligonucleotide
gauuacaaacgcauaguag

SEQ ID NO: 19163 - RNA, 19 nt, Artificial Sequence
  Synthetic oligonucleotide
auuacaaacgcauaguagc

SEQ ID NO: 19164 - RNA, 19 nt, Artificial Sequence
  Synthetic oligonucleotide
uuacaaacgcauaguagca

SEQ ID NO: 19165 - RNA, 19 nt, Artificial Sequence
  Synthetic oligonucleotide
uacaaacgcauaguagcau

SEQ ID NO: 19166 - RNA, 19 nt, Artificial Sequence
  Synthetic oligonucleotide
acaaacgcauaguagcaug

SEQ ID NO: 19167 - RNA, 19 nt, Artificial Sequence
  Synthetic oligonucleotide
caaacgcauaguagcaugu

SEQ ID NO: 19168 - RNA, 19 nt, Artificial Sequence
  Synthetic oligonucleotide
aaacgcauaguagcaugug

SEQ ID NO: 19169 - RNA, 19 nt, Artificial Sequence
  Synthetic oligonucleotide
aacgcauaguagcaugugc

SEQ ID NO: 19170 - RNA, 19 nt, Artificial Sequence
  Synthetic oligonucleotide
acgcauaguagcaugugcc

SEQ ID NO: 19171 - RNA, 19 nt, Artificial Sequence
  Synthetic oligonucleotide
cgcauaguagcaugugcca

SEQ ID NO: 19172 - RNA, 19 nt, Artificial Sequence
  Synthetic oligonucleotide
gcauaguagcaugugccag

SEQ ID NO: 19173 - RNA, 19 nt, Artificial Sequence
  Synthetic oligonucleotide
cauaguagcaugugccagc

SEQ ID NO: 19174 - RNA, 19 nt, Artificial Sequence
  Synthetic oligonucleotide
auaguagcaugugccagcu

SEQ ID NO: 19175 - RNA, 19 nt, Artificial Sequence
  Synthetic oligonucleotide
uaguagcaugugccagcua

SEQ ID NO: 19176 - RNA, 19 nt, Artificial Sequence
  Synthetic oligonucleotide
aguagcaugugccagcuac

SEQ ID NO: 19177 - RNA, 19 nt, Artificial Sequence
  Synthetic oligonucleotide
ggugauggacaucuccuug

SEQ ID NO: 19178 - RNA, 19 nt, Artificial Sequence
  Synthetic oligonucleotide
gugauggacaucuccuugc

SEQ ID NO: 19179 - RNA, 19 nt, Artificial Sequence
  Synthetic oligonucleotide
ugauggacaucuccuugcc

SEQ ID NO: 19180 - RNA, 19 nt, Artificial Sequence
  Synthetic oligonucleotide
gauggacaucuccuugccu

SEQ ID NO: 19181 - RNA, 19 nt, Artificial Sequence
  Synthetic oligonucleotide
auggacaucuccuugccua

SEQ ID NO: 19182 - RNA, 19 nt, Artificial Sequence
  Synthetic oligonucleotide
uggacaucuccuugccuac

SEQ ID NO: 19183 - RNA, 19 nt, Artificial Sequence
  Synthetic oligonucleotide
ggacaucuccuugccuacu

SEQ ID NO: 19184 - RNA, 19 nt, Artificial Sequence
  Synthetic oligonucleotide
gacaucuccuugccuacug

SEQ ID NO: 19185 - RNA, 19 nt, Artificial Sequence
  Synthetic oligonucleotide
acaucuccuugccuacugg

SEQ ID NO: 19186 - RNA, 19 nt, Artificial Sequence
  Synthetic oligonucleotide
caucuccuugccuacugga

SEQ ID NO: 19187 - RNA, 19 nt, Artificial Sequence
  Synthetic oligonucleotide
aucuccuugccuacuggaa

SEQ ID NO: 19188 - RNA, 19 nt, Artificial Sequence
  Synthetic oligonucleotide
ucuccuugccuacuggaau

SEQ ID NO: 19189 - RNA, 19 nt, Artificial Sequence
  Synthetic oligonucleotide
cuccuugccuacuggaauc

SEQ ID NO: 19190 - RNA, 19 nt, Artificial Sequence
  Synthetic oligonucleotide
gugcaaaugaagaagacuu

SEQ ID NO: 19191 - RNA, 19 nt, Artificial Sequence
  Synthetic oligonucleotide
ugcaaaugaagaagacuua

SEQ ID NO: 19192 - RNA, 19 nt, Artificial Sequence
  Synthetic oligonucleotide
gcaaaugaagaagacuuaa

SEQ ID NO: 19193 - RNA, 19 nt, Artificial Sequence
  Synthetic oligonucleotide
caaaugaagaagacuuaaa

SEQ ID NO: 19194 - RNA, 19 nt, Artificial Sequence
  Synthetic oligonucleotide
aaaugaagaagacuuaaaa

SEQ ID NO: 19195 - RNA, 19 nt, Artificial Sequence
  Synthetic oligonucleotide
aaugaagaagacuuaaaag

SEQ ID NO: 19196 - RNA, 19 nt, Artificial Sequence
  Synthetic oligonucleotide
ccuuguggaagggguggau

SEQ ID NO: 19197 - RNA, 19 nt, Artificial Sequence
  Synthetic oligonucleotide
cuuguggaagggguggauc

SEQ ID NO: 19198 - RNA, 19 nt, Artificial Sequence
  Synthetic oligonucleotide
acuauucacugauuaccaa

SEQ ID NO: 19199 - RNA, 19 nt, Artificial Sequence
  Synthetic oligonucleotide
cuauucacugauuaccaaa

SEQ ID NO: 19200 - RNA, 19 nt, Artificial Sequence
  Synthetic oligonucleotide
caaagauggacauguuauu

SEQ ID NO: 19201 - RNA, 19 nt, Artificial Sequence
  Synthetic oligonucleotide
aaagauggacauguuauuc

SEQ ID NO: 19202 - RNA, 19 nt, Artificial Sequence
  Synthetic oligonucleotide
aagauggacauguuauucu

SEQ ID NO: 19203 - RNA, 19 nt, Artificial Sequence
  Synthetic oligonucleotide
auggacauguuauucugca

SEQ ID NO: 19204 - RNA, 19 nt, Artificial Sequence
  Synthetic oligonucleotide
ggacauguuauucugcaac

SEQ ID NO: 19205 - RNA, 19 nt, Artificial Sequence
  Synthetic oligonucleotide
auguuauucugcaacugaa

SEQ ID NO: 19206 - RNA, 19 nt, Artificial Sequence
  Synthetic oligonucleotide
uguuauucugcaacugaau

SEQ ID NO: 19207 - RNA, 19 nt, Artificial Sequence
  Synthetic oligonucleotide
guuauucugcaacugaauu

SEQ ID NO: 19208 - RNA, 19 nt, Artificial Sequence
  Synthetic oligonucleotide
uuauucugcaacugaauuc

SEQ ID NO: 19209 - RNA, 19 nt, Artificial Sequence
  Synthetic oligonucleotide
auuugaacucuuugaaguu

SEQ ID NO: 19210 - RNA, 19 nt, Artificial Sequence
  Synthetic oligonucleotide
uuugaacucuuugaaguug

SEQ ID NO: 19211 - RNA, 19 nt, Artificial Sequence
  Synthetic oligonucleotide
uugaacucuuugaaguugg

SEQ ID NO: 19212 - RNA, 19 nt, Artificial Sequence
  Synthetic oligonucleotide
ugaacucuuugaaguuggg

SEQ ID NO: 19213 - RNA, 19 nt, Artificial Sequence
  Synthetic oligonucleotide
gaacucuuugaaguugggu

SEQ ID NO: 19214 - RNA, 19 nt, Artificial Sequence
  Synthetic oligonucleotide
aacucuuugaaguuggguu

SEQ ID NO: 19215 - RNA, 19 nt, Artificial Sequence
  Synthetic oligonucleotide
acucuuugaaguuggguuu

SEQ ID NO: 19216 - RNA, 19 nt, Artificial Sequence
  Synthetic oligonucleotide
cucuuugaaguuggguuuc

SEQ ID NO: 19217 - RNA, 19 nt, Artificial Sequence
  Synthetic oligonucleotide
caguccugccacuuucaca

SEQ ID NO: 19218 - RNA, 19 nt, Artificial Sequence
  Synthetic oligonucleotide
aguccugccacuuucacag

SEQ ID NO: 19219 - RNA, 19 nt, Artificial Sequence
  Synthetic oligonucleotide
guccugccacuuucacagu

SEQ ID NO: 19220 - RNA, 19 nt, Artificial Sequence
  Synthetic oligonucleotide
uccugccacuuucacagug

SEQ ID NO: 19221 - RNA, 19 nt, Artificial Sequence
  Synthetic oligonucleotide
ccugccacuuucacagugu

SEQ ID NO: 19222 - RNA, 19 nt, Artificial Sequence
  Synthetic oligonucleotide
cgaauaccacagaccagau

SEQ ID NO: 19223 - RNA, 19 nt, Artificial Sequence
  Synthetic oligonucleotide
gaauaccacagaccagaua

SEQ ID NO: 19224 - RNA, 19 nt, Artificial Sequence
  Synthetic oligonucleotide
aauaccacagaccagauaa

SEQ ID NO: 19225 - RNA, 19 nt, Artificial Sequence
  Synthetic oligonucleotide
auaccacagaccagauaaa

SEQ ID NO: 19226 - RNA, 19 nt, Artificial Sequence
  Synthetic oligonucleotide
uaccacagaccagauaaac

SEQ ID NO: 19227 - RNA, 19 nt, Artificial Sequence
  Synthetic oligonucleotide
accacagaccagauaaaca

SEQ ID NO: 19228 - RNA, 19 nt, Artificial Sequence
  Synthetic oligonucleotide
ccacagaccagauaaacag

SEQ ID NO: 19229 - RNA, 19 nt, Artificial Sequence
  Synthetic oligonucleotide
cacagaccagauaaacagu

SEQ ID NO: 19230 - RNA, 19 nt, Artificial Sequence
  Synthetic oligonucleotide
acagaccagauaaacagug

SEQ ID NO: 19231 - RNA, 19 nt, Artificial Sequence
  Synthetic oligonucleotide
cagaccagauaaacagugu

SEQ ID NO: 19232 - RNA, 19 nt, Artificial Sequence
  Synthetic oligonucleotide
agaccagauaaacagugua

SEQ ID NO: 19233 - RNA, 19 nt, Artificial Sequence
  Synthetic oligonucleotide
gaccagauaaacaguguac

SEQ ID NO: 19234 - RNA, 19 nt, Artificial Sequence
  Synthetic oligonucleotide
accagauaaacaguguacc

SEQ ID NO: 19235 - RNA, 19 nt, Artificial Sequence
  Synthetic oligonucleotide
ccagauaaacaguguacca

SEQ ID NO: 19236 - RNA, 19 nt, Artificial Sequence
  Synthetic oligonucleotide
cagauaaacaguguaccau

SEQ ID NO: 19237 - RNA, 19 nt, Artificial Sequence
  Synthetic oligonucleotide
auaaacaguguaccauguu

SEQ ID NO: 19238 - RNA, 19 nt, Artificial Sequence
  Synthetic oligonucleotide
aaacaguguaccauguuuu

SEQ ID NO: 19239 - RNA, 19 nt, Artificial Sequence
  Synthetic oligonucleotide
acaguguaccauguuuuau

SEQ ID NO: 19240 - RNA, 19 nt, Artificial Sequence
  Synthetic oligonucleotide
caguguaccauguuuuaua

SEQ ID NO: 19241 - RNA, 19 nt, Artificial Sequence
  Synthetic oligonucleotide
aguguaccauguuuuauag

SEQ ID NO: 19242 - RNA, 19 nt, Artificial Sequence
  Synthetic oligonucleotide
guguaccauguuuuauagc

SEQ ID NO: 19243 - RNA, 19 nt, Artificial Sequence
  Synthetic oligonucleotide
uguaccauguuuuauagca

SEQ ID NO: 19244 - RNA, 19 nt, Artificial Sequence
  Synthetic oligonucleotide
guaccauguuuuauagcac

SEQ ID NO: 19245 - RNA, 19 nt, Artificial Sequence
  Synthetic oligonucleotide
uaccauguuuuauagcacu

SEQ ID NO: 19246 - RNA, 19 nt, Artificial Sequence
  Synthetic oligonucleotide
accauguuuuauagcacuu

SEQ ID NO: 19247 - RNA, 19 nt, Artificial Sequence
  Synthetic oligonucleotide
ccauguuuuauagcacuuc

SEQ ID NO: 19248 - RNA, 19 nt, Artificial Sequence
  Synthetic oligonucleotide
cauguuuuauagcacuucc

SEQ ID NO: 19249 - RNA, 19 nt, Artificial Sequence
  Synthetic oligonucleotide
auguuuuauagcacuucca

SEQ ID NO: 19250 - RNA, 19 nt, Artificial Sequence
  Synthetic oligonucleotide
uguuuuauagcacuuccaa

SEQ ID NO: 19251 - RNA, 19 nt, Artificial Sequence
  Synthetic oligonucleotide
guuuuauagcacuuccaau

SEQ ID NO: 19252 - RNA, 19 nt, Artificial Sequence
  Synthetic oligonucleotide
uuuuauagcacuuccaaua

SEQ ID NO: 19253 - RNA, 19 nt, Artificial Sequence
  Synthetic oligonucleotide
uuuauagcacuuccaauau

SEQ ID NO: 19254 - RNA, 19 nt, Artificial Sequence
  Synthetic oligonucleotide
uuauagcacuuccaauauc

SEQ ID NO: 19255 - RNA, 19 nt, Artificial Sequence
  Synthetic oligonucleotide
auagcacuuccaauaucaa

SEQ ID NO: 19256 - RNA, 19 nt, Artificial Sequence
  Synthetic oligonucleotide
uagcacuuccaauaucaaa

SEQ ID NO: 19257 - RNA, 19 nt, Artificial Sequence
  Synthetic oligonucleotide
agcacuuccaauaucaaaa

SEQ ID NO: 19258 - RNA, 19 nt, Artificial Sequence
  Synthetic oligonucleotide
gcacuuccaauaucaaaau

SEQ ID NO: 19259 - RNA, 19 nt, Artificial Sequence
  Synthetic oligonucleotide
cacuuccaauaucaaaauu

SEQ ID NO: 19260 - RNA, 19 nt, Artificial Sequence
  Synthetic oligonucleotide
acuuccaauaucaaaauuc

SEQ ID NO: 19261 - RNA, 19 nt, Artificial Sequence
  Synthetic oligonucleotide
cuuccaauaucaaaauuca

SEQ ID NO: 19262 - RNA, 19 nt, Artificial Sequence
  Synthetic oligonucleotide
uuccaauaucaaaauucag

SEQ ID NO: 19263 - RNA, 19 nt, Artificial Sequence
  Synthetic oligonucleotide
uccaauaucaaaauucaga

SEQ ID NO: 19264 - RNA, 19 nt, Artificial Sequence
  Synthetic oligonucleotide
ccaauaucaaaauucagaa

SEQ ID NO: 19265 - RNA, 19 nt, Artificial Sequence
  Synthetic oligonucleotide
caauaucaaaauucagaaa

SEQ ID NO: 19266 - RNA, 19 nt, Artificial Sequence
  Synthetic oligonucleotide
aauaucaaaauucagaaag

SEQ ID NO: 19267 - RNA, 19 nt, Artificial Sequence
  Synthetic oligonucleotide
auaucaaaauucagaaagu

SEQ ID NO: 19268 - RNA, 19 nt, Artificial Sequence
  Synthetic oligonucleotide
uaucaaaauucagaaaguc

SEQ ID NO: 19269 - RNA, 19 nt, Artificial Sequence
  Synthetic oligonucleotide
aucaaaauucagaaagucu

SEQ ID NO: 19270 - RNA, 19 nt, Artificial Sequence
  Synthetic oligonucleotide
ucaaaauucagaaagucug

SEQ ID NO: 19271 - RNA, 19 nt, Artificial Sequence
  Synthetic oligonucleotide
caaaauucagaaagucugu

SEQ ID NO: 19272 - RNA, 19 nt, Artificial Sequence
  Synthetic oligonucleotide
aaaauucagaaagucugug

SEQ ID NO: 19273 - RNA, 19 nt, Artificial Sequence
  Synthetic oligonucleotide
aaauucagaaagucuguga

SEQ ID NO: 19274 - RNA, 19 nt, Artificial Sequence
  Synthetic oligonucleotide
aauucagaaagucugugaa

SEQ ID NO: 19275 - RNA, 19 nt, Artificial Sequence
  Synthetic oligonucleotide
agaaagucugugaaggagc

SEQ ID NO: 19276 - RNA, 19 nt, Artificial Sequence
  Synthetic oligonucleotide
guagaagcugauugugggc

SEQ ID NO: 19277 - RNA, 19 nt, Artificial Sequence
  Synthetic oligonucleotide
uagaagcugauugugggca

SEQ ID NO: 19278 - RNA, 19 nt, Artificial Sequence
  Synthetic oligonucleotide
agaagcugauugugggcaa

SEQ ID NO: 19279 - RNA, 19 nt, Artificial Sequence
  Synthetic oligonucleotide
gaagcugauugugggcaaa

SEQ ID NO: 19280 - RNA, 19 nt, Artificial Sequence
  Synthetic oligonucleotide
aagcugauugugggcaaau

SEQ ID NO: 19281 - RNA, 19 nt, Artificial Sequence
  Synthetic oligonucleotide
agcugauugugggcaaaug

SEQ ID NO: 19282 - RNA, 19 nt, Artificial Sequence
  Synthetic oligonucleotide
gcugauugugggcaaaugc

SEQ ID NO: 19283 - RNA, 19 nt, Artificial Sequence
  Synthetic oligonucleotide
cugauugugggcaaaugca

SEQ ID NO: 19284 - RNA, 19 nt, Artificial Sequence
  Synthetic oligonucleotide
gaagaauuggaucugacaa

SEQ ID NO: 19285 - RNA, 19 nt, Artificial Sequence
  Synthetic oligonucleotide
aagaauuggaucugacaau

SEQ ID NO: 19286 - RNA, 19 nt, Artificial Sequence
  Synthetic oligonucleotide
agaauuggaucugacaauc

SEQ ID NO: 19287 - RNA, 19 nt, Artificial Sequence
  Synthetic oligonucleotide
gaauuggaucugacaaucu

SEQ ID NO: 19288 - RNA, 19 nt, Artificial Sequence
  Synthetic oligonucleotide
aauuggaucugacaaucuc

SEQ ID NO: 19289 - RNA, 19 nt, Artificial Sequence
  Synthetic oligonucleotide
auuggaucugacaaucucu

SEQ ID NO: 19290 - RNA, 19 nt, Artificial Sequence
  Synthetic oligonucleotide
uuggaucugacaaucucug

SEQ ID NO: 19291 - RNA, 19 nt, Artificial Sequence
  Synthetic oligonucleotide
uggaucugacaaucucugc

SEQ ID NO: 19292 - RNA, 19 nt, Artificial Sequence
  Synthetic oligonucleotide
ggaucugacaaucucugca

SEQ ID NO: 19293 - RNA, 19 nt, Artificial Sequence
  Synthetic oligonucleotide
gaucugacaaucucugcag

SEQ ID NO: 19294 - RNA, 19 nt, Artificial Sequence
  Synthetic oligonucleotide
aucugacaaucucugcaga

SEQ ID NO: 19295 - RNA, 19 nt, Artificial Sequence
  Synthetic oligonucleotide
ucugacaaucucugcagag

SEQ ID NO: 19296 - RNA, 19 nt, Artificial Sequence
  Synthetic oligonucleotide
cugacaaucucugcagaga

SEQ ID NO: 19297 - RNA, 19 nt, Artificial Sequence
  Synthetic oligonucleotide
aagaaaacaaacagcaugu

SEQ ID NO: 19298 - RNA, 19 nt, Artificial Sequence
  Synthetic oligonucleotide
agaaaacaaacagcaugua

SEQ ID NO: 19299 - RNA, 19 nt, Artificial Sequence
  Synthetic oligonucleotide
agauugcauaugcuuauaa

SEQ ID NO: 19300 - RNA, 19 nt, Artificial Sequence
  Synthetic oligonucleotide
gauugcauaugcuuauaaa

SEQ ID NO: 19301 - RNA, 19 nt, Artificial Sequence
  Synthetic oligonucleotide
auugcauaugcuuauaaag

SEQ ID NO: 19302 - RNA, 19 nt, Artificial Sequence
  Synthetic oligonucleotide
uugcauaugcuuauaaagu

SEQ ID NO: 19303 - RNA, 19 nt, Artificial Sequence
  Synthetic oligonucleotide
ugcauaugcuuauaaaguu

SEQ ID NO: 19304 - RNA, 19 nt, Artificial Sequence
  Synthetic oligonucleotide
aauguuuuugucaaguaca

SEQ ID NO: 19305 - RNA, 19 nt, Artificial Sequence
  Synthetic oligonucleotide
auguuuuugucaaguacaa

SEQ ID NO: 19306 - RNA, 19 nt, Artificial Sequence
  Synthetic oligonucleotide
uguuuuugucaaguacaag

SEQ ID NO: 19307 - RNA, 19 nt, Artificial Sequence
  Synthetic oligonucleotide
guuuuugucaaguacaagg

SEQ ID NO: 19308 - RNA, 19 nt, Artificial Sequence
  Synthetic oligonucleotide
uuuuugucaaguacaaggc

SEQ ID NO: 19309 - RNA, 19 nt, Artificial Sequence
  Synthetic oligonucleotide
uuuugucaaguacaaggca

SEQ ID NO: 19310 - RNA, 19 nt, Artificial Sequence
  Synthetic oligonucleotide
uuugucaaguacaaggcaa

SEQ ID NO: 19311 - RNA, 19 nt, Artificial Sequence
  Synthetic oligonucleotide
uugucaaguacaaggcaac

SEQ ID NO: 19312 - RNA, 19 nt, Artificial Sequence
  Synthetic oligonucleotide
ugucaaguacaaggcaacc

SEQ ID NO: 19313 - RNA, 19 nt, Artificial Sequence
  Synthetic oligonucleotide
gucaaguacaaggcaaccc

SEQ ID NO: 19314 - RNA, 19 nt, Artificial Sequence
  Synthetic oligonucleotide
ucaaguacaaggcaacccu

SEQ ID NO: 19315 - RNA, 19 nt, Artificial Sequence
  Synthetic oligonucleotide
caaguacaaggcaacccuu

SEQ ID NO: 19316 - RNA, 19 nt, Artificial Sequence
  Synthetic oligonucleotide
aaguacaaggcaacccuuc

SEQ ID NO: 19317 - RNA, 19 nt, Artificial Sequence
  Synthetic oligonucleotide
aguacaaggcaacccuucu

SEQ ID NO: 19318 - RNA, 19 nt, Artificial Sequence
  Synthetic oligonucleotide
guacaaggcaacccuucug

SEQ ID NO: 19319 - RNA, 19 nt, Artificial Sequence
  Synthetic oligonucleotide
uacaaggcaacccuucugg

SEQ ID NO: 19320 - RNA, 19 nt, Artificial Sequence
  Synthetic oligonucleotide
acaaggcaacccuucugga

SEQ ID NO: 19321 - RNA, 19 nt, Artificial Sequence
  Synthetic oligonucleotide
caaggcaacccuucuggau

SEQ ID NO: 19322 - RNA, 19 nt, Artificial Sequence
  Synthetic oligonucleotide
aaggcaacccuucuggaua

SEQ ID NO: 19323 - RNA, 19 nt, Artificial Sequence
  Synthetic oligonucleotide
aggcaacccuucuggauau

SEQ ID NO: 19324 - RNA, 19 nt, Artificial Sequence
  Synthetic oligonucleotide
ggcaacccuucuggauauc

SEQ ID NO: 19325 - RNA, 19 nt, Artificial Sequence
  Synthetic oligonucleotide
gcaacccuucuggauaucu

SEQ ID NO: 19326 - RNA, 19 nt, Artificial Sequence
  Synthetic oligonucleotide
caacccuucuggauaucua

SEQ ID NO: 19327 - RNA, 19 nt, Artificial Sequence
  Synthetic oligonucleotide
aacccuucuggauaucuac

SEQ ID NO: 19328 - RNA, 19 nt, Artificial Sequence
  Synthetic oligonucleotide
acccuucuggauaucuaca

SEQ ID NO: 19329 - RNA, 19 nt, Artificial Sequence
  Synthetic oligonucleotide
cccuucuggauaucuacaa

SEQ ID NO: 19330 - RNA, 19 nt, Artificial Sequence
  Synthetic oligonucleotide
ccuucuggauaucuacaaa

SEQ ID NO: 19331 - RNA, 19 nt, Artificial Sequence
  Synthetic oligonucleotide
cuucuggauaucuacaaaa

SEQ ID NO: 19332 - RNA, 19 nt, Artificial Sequence
  Synthetic oligonucleotide
uucuggauaucuacaaaac

SEQ ID NO: 19333 - RNA, 19 nt, Artificial Sequence
  Synthetic oligonucleotide
ucuggauaucuacaaaacu

SEQ ID NO: 19334 - RNA, 19 nt, Artificial Sequence
  Synthetic oligonucleotide
cuggauaucuacaaaacug

SEQ ID NO: 19335 - RNA, 19 nt, Artificial Sequence
  Synthetic oligonucleotide
uggauaucuacaaaacugg

SEQ ID NO: 19336 - RNA, 19 nt, Artificial Sequence
  Synthetic oligonucleotide
ggauaucuacaaaacuggg

SEQ ID NO: 19337 - RNA, 19 nt, Artificial Sequence
  Synthetic oligonucleotide
gauaucuacaaaacugggg

SEQ ID NO: 19338 - RNA, 19 nt, Artificial Sequence
  Synthetic oligonucleotide
auaucuacaaaacugggga

SEQ ID NO: 19339 - RNA, 19 nt, Artificial Sequence
  Synthetic oligonucleotide
uaucuacaaaacuggggaa

SEQ ID NO: 19340 - RNA, 19 nt, Artificial Sequence
  Synthetic oligonucleotide
aucuacaaaacuggggaag

SEQ ID NO: 19341 - RNA, 19 nt, Artificial Sequence
  Synthetic oligonucleotide
ucuacaaaacuggggaagc

SEQ ID NO: 19342 - RNA, 19 nt, Artificial Sequence
  Synthetic oligonucleotide
cuacaaaacuggggaagcu

SEQ ID NO: 19343 - RNA, 19 nt, Artificial Sequence
  Synthetic oligonucleotide
uacaaaacuggggaagcug

SEQ ID NO: 19344 - RNA, 19 nt, Artificial Sequence
  Synthetic oligonucleotide
acaaaacuggggaagcugu

SEQ ID NO: 19345 - RNA, 19 nt, Artificial Sequence
  Synthetic oligonucleotide
caaaacuggggaagcuguu

SEQ ID NO: 19346 - RNA, 19 nt, Artificial Sequence
  Synthetic oligonucleotide
aaaacuggggaagcuguug

SEQ ID NO: 19347 - RNA, 19 nt, Artificial Sequence
  Synthetic oligonucleotide
aaacuggggaagcuguugc

SEQ ID NO: 19348 - RNA, 19 nt, Artificial Sequence
  Synthetic oligonucleotide
aacuggggaagcuguugcu

SEQ ID NO: 19349 - RNA, 19 nt, Artificial Sequence
  Synthetic oligonucleotide
acuggggaagcuguugcug

SEQ ID NO: 19350 - RNA, 19 nt, Artificial Sequence
  Synthetic oligonucleotide
uaccuucauuaaaaaggua

SEQ ID NO: 19351 - RNA, 19 nt, Artificial Sequence
  Synthetic oligonucleotide
accuucauuaaaaagguaa

SEQ ID NO: 19352 - RNA, 19 nt, Artificial Sequence
  Synthetic oligonucleotide
ccuucauuaaaaagguaac

SEQ ID NO: 19353 - RNA, 19 nt, Artificial Sequence
  Synthetic oligonucleotide
cuucauuaaaaagguaacc

SEQ ID NO: 19354 - RNA, 19 nt, Artificial Sequence
  Synthetic oligonucleotide
uucauuaaaaagguaaccu

SEQ ID NO: 19355 - RNA, 19 nt, Artificial Sequence
  Synthetic oligonucleotide
aaaaggaagacaguacuua

SEQ ID NO: 19356 - RNA, 19 nt, Artificial Sequence
  Synthetic oligonucleotide
aaaggaagacaguacuuaa

SEQ ID NO: 19357 - RNA, 19 nt, Artificial Sequence
  Synthetic oligonucleotide
aaggaagacaguacuuaau

SEQ ID NO: 19358 - RNA, 19 nt, Artificial Sequence
  Synthetic oligonucleotide
aggaagacaguacuuaauu

SEQ ID NO: 19359 - RNA, 19 nt, Artificial Sequence
  Synthetic oligonucleotide
ggaagacaguacuuaauua

SEQ ID NO: 19360 - RNA, 19 nt, Artificial Sequence
  Synthetic oligonucleotide
gaagacaguacuuaauuau

SEQ ID NO: 19361 - RNA, 19 nt, Artificial Sequence
  Synthetic oligonucleotide
aagacaguacuuaauuaug

SEQ ID NO: 19362 - RNA, 19 nt, Artificial Sequence
  Synthetic oligonucleotide
agacaguacuuaauuaugg

SEQ ID NO: 19363 - RNA, 19 nt, Artificial Sequence
  Synthetic oligonucleotide
ccuccagauaaaauacaau

SEQ ID NO: 19364 - RNA, 19 nt, Artificial Sequence
  Synthetic oligonucleotide
cuccagauaaaauacaauu

SEQ ID NO: 19365 - RNA, 19 nt, Artificial Sequence
  Synthetic oligonucleotide
ccagauaaaauacaauuuc

SEQ ID NO: 19366 - RNA, 19 nt, Artificial Sequence
  Synthetic oligonucleotide
guuucagguacaucuaccc

SEQ ID NO: 19367 - RNA, 19 nt, Artificial Sequence
  Synthetic oligonucleotide
uuucagguacaucuacccu

SEQ ID NO: 19368 - RNA, 19 nt, Artificial Sequence
  Synthetic oligonucleotide
uucagguacaucuacccuu

SEQ ID NO: 19369 - RNA, 19 nt, Artificial Sequence
  Synthetic oligonucleotide
ucagguacaucuacccuuu

SEQ ID NO: 19370 - RNA, 19 nt, Artificial Sequence
  Synthetic oligonucleotide
cagguacaucuacccuuua

SEQ ID NO: 19371 - RNA, 19 nt, Artificial Sequence
  Synthetic oligonucleotide
agguacaucuacccuuuag

SEQ ID NO: 19372 - RNA, 19 nt, Artificial Sequence
  Synthetic oligonucleotide
gguacaucuacccuuuaga

SEQ ID NO: 19373 - RNA, 19 nt, Artificial Sequence
  Synthetic oligonucleotide
guacaucuacccuuuagau

SEQ ID NO: 19374 - RNA, 19 nt, Artificial Sequence
  Synthetic oligonucleotide
uacaucuacccuuuagauu

SEQ ID NO: 19375 - RNA, 19 nt, Artificial Sequence
  Synthetic oligonucleotide
acaucuacccuuuagauuc

SEQ ID NO: 19376 - RNA, 19 nt, Artificial Sequence
  Synthetic oligonucleotide
caucuacccuuuagauucc

SEQ ID NO: 19377 - RNA, 19 nt, Artificial Sequence
  Synthetic oligonucleotide
aucuacccuuuagauuccu

SEQ ID NO: 19378 - RNA, 19 nt, Artificial Sequence
  Synthetic oligonucleotide
ucuacccuuuagauuccuu

SEQ ID NO: 19379 - RNA, 19 nt, Artificial Sequence
  Synthetic oligonucleotide
cuacccuuuagauuccuug

SEQ ID NO: 19380 - RNA, 19 nt, Artificial Sequence
  Synthetic oligonucleotide
uacccuuuagauuccuuga

SEQ ID NO: 19381 - RNA, 19 nt, Artificial Sequence
  Synthetic oligonucleotide
acccuuuagauuccuugac

SEQ ID NO: 19382 - RNA, 19 nt, Artificial Sequence
  Synthetic oligonucleotide
cccuuuagauuccuugacc

SEQ ID NO: 19383 - RNA, 19 nt, Artificial Sequence
  Synthetic oligonucleotide
ccuuuagauuccuugaccu

SEQ ID NO: 19384 - RNA, 19 nt, Artificial Sequence
  Synthetic oligonucleotide
cuuuagauuccuugaccug

SEQ ID NO: 19385 - RNA, 19 nt, Artificial Sequence
  Synthetic oligonucleotide
uuuagauuccuugaccugg

SEQ ID NO: 19386 - RNA, 19 nt, Artificial Sequence
  Synthetic oligonucleotide
uuagauuccuugaccugga

SEQ ID NO: 19387 - RNA, 19 nt, Artificial Sequence
  Synthetic oligonucleotide
uagauuccuugaccuggau

SEQ ID NO: 19388 - RNA, 19 nt, Artificial Sequence
  Synthetic oligonucleotide
agauuccuugaccuggauu

SEQ ID NO: 19389 - RNA, 19 nt, Artificial Sequence
  Synthetic oligonucleotide
gauuccuugaccuggauug

SEQ ID NO: 19390 - RNA, 19 nt, Artificial Sequence
  Synthetic oligonucleotide
auuccuugaccuggauuga

SEQ ID NO: 19391 - RNA, 19 nt, Artificial Sequence
  Synthetic oligonucleotide
uuccuugaccuggauugaa

SEQ ID NO: 19392 - RNA, 19 nt, Artificial Sequence
  Synthetic oligonucleotide
uccuugaccuggauugaau

SEQ ID NO: 19393 - RNA, 19 nt, Artificial Sequence
  Synthetic oligonucleotide
ccuugaccuggauugaaua

SEQ ID NO: 19394 - RNA, 19 nt, Artificial Sequence
  Synthetic oligonucleotide
cuugaccuggauugaauac

SEQ ID NO: 19395 - RNA, 19 nt, Artificial Sequence
  Synthetic oligonucleotide
uugaccuggauugaauacu

SEQ ID NO: 19396 - RNA, 19 nt, Artificial Sequence
  Synthetic oligonucleotide
ugaccuggauugaauacug

SEQ ID NO: 19397 - RNA, 19 nt, Artificial Sequence
  Synthetic oligonucleotide
gaccuggauugaauacugg

SEQ ID NO: 19398 - RNA, 19 nt, Artificial Sequence
  Synthetic oligonucleotide
accuggauugaauacuggc

SEQ ID NO: 19399 - RNA, 19 nt, Artificial Sequence
  Synthetic oligonucleotide
ccuggauugaauacuggcc

SEQ ID NO: 19400 - RNA, 19 nt, Artificial Sequence
  Synthetic oligonucleotide
cuggauugaauacuggccu

SEQ ID NO: 19401 - RNA, 19 nt, Artificial Sequence
  Synthetic oligonucleotide
uggauugaauacuggccua

SEQ ID NO: 19402 - RNA, 19 nt, Artificial Sequence
  Synthetic oligonucleotide
acaacauguucaucguguc

SEQ ID NO: 19403 - RNA, 19 nt, Artificial Sequence
  Synthetic oligonucleotide
caacauguucaucguguca

SEQ ID NO: 19404 - RNA, 19 nt, Artificial Sequence
  Synthetic oligonucleotide
aacauguucaucgugucaa

SEQ ID NO: 19405 - RNA, 19 nt, Artificial Sequence
  Synthetic oligonucleotide
acauguucaucgugucaag

SEQ ID NO: 19406 - RNA, 19 nt, Artificial Sequence
  Synthetic oligonucleotide
auguucaucgugucaagca

SEQ ID NO: 19407 - RNA, 19 nt, Artificial Sequence
  Synthetic oligonucleotide
uguucaucgugucaagcau

SEQ ID NO: 19408 - RNA, 19 nt, Artificial Sequence
  Synthetic oligonucleotide
guucaucgugucaagcauu

SEQ ID NO: 19409 - RNA, 19 nt, Artificial Sequence
  Synthetic oligonucleotide
uucaucgugucaagcauuu

SEQ ID NO: 19410 - RNA, 19 nt, Artificial Sequence
  Synthetic oligonucleotide
caucgugucaagcauuuuu

SEQ ID NO: 19411 - RNA, 19 nt, Artificial Sequence
  Synthetic oligonucleotide
aucgugucaagcauuuuua

SEQ ID NO: 19412 - RNA, 19 nt, Artificial Sequence
  Synthetic oligonucleotide
ucgugucaagcauuuuuag

SEQ ID NO: 19413 - RNA, 19 nt, Artificial Sequence
  Synthetic oligonucleotide
gugucaagcauuuuuagcu

SEQ ID NO: 19414 - RNA, 19 nt, Artificial Sequence
  Synthetic oligonucleotide
ugucaagcauuuuuagcua

SEQ ID NO: 19415 - RNA, 19 nt, Artificial Sequence
  Synthetic oligonucleotide
gucaagcauuuuuagcuaa

SEQ ID NO: 19416 - RNA, 19 nt, Artificial Sequence
  Synthetic oligonucleotide
ucaagcauuuuuagcuaau

SEQ ID NO: 19417 - RNA, 19 nt, Artificial Sequence
  Synthetic oligonucleotide
aagcauuuuuagcuaauuu

SEQ ID NO: 19418 - RNA, 19 nt, Artificial Sequence
  Synthetic oligonucleotide
agcauuuuuagcuaauuua

SEQ ID NO: 19419 - RNA, 19 nt, Artificial Sequence
  Synthetic oligonucleotide
gcauuuuuagcuaauuuag

SEQ ID NO: 19420 - RNA, 19 nt, Artificial Sequence
  Synthetic oligonucleotide
cauuuuuagcuaauuuaga

SEQ ID NO: 19421 - RNA, 19 nt, Artificial Sequence
  Synthetic oligonucleotide
auuuuuagcuaauuuagau

SEQ ID NO: 19422 - RNA, 19 nt, Artificial Sequence
  Synthetic oligonucleotide
uuuuuagcuaauuuagaug

SEQ ID NO: 19423 - RNA, 19 nt, Artificial Sequence
  Synthetic oligonucleotide
uuuuagcuaauuuagauga

SEQ ID NO: 19424 - RNA, 19 nt, Artificial Sequence
  Synthetic oligonucleotide
uuuagcuaauuuagaugaa

SEQ ID NO: 19425 - RNA, 19 nt, Artificial Sequence
  Synthetic oligonucleotide
uuagcuaauuuagaugaau

SEQ ID NO: 19426 - RNA, 19 nt, Artificial Sequence
  Synthetic oligonucleotide
uagcuaauuuagaugaauu

SEQ ID NO: 19427 - RNA, 19 nt, Artificial Sequence
  Synthetic oligonucleotide
agcuaauuuagaugaauuu

SEQ ID NO: 19428 - RNA, 19 nt, Artificial Sequence
  Synthetic oligonucleotide
gcuaauuuagaugaauuug

SEQ ID NO: 19429 - RNA, 19 nt, Artificial Sequence
  Synthetic oligonucleotide
uaucuuuuuaaauggaugc

SEQ ID NO: 19430 - RNA, 19 nt, Artificial Sequence
  Synthetic oligonucleotide
aucuuuuuaaauggaugcu

SEQ ID NO: 19431 - RNA, 19 nt, Artificial Sequence
  Synthetic oligonucleotide
ucuuuuuaaauggaugcua

SEQ ID NO: 19432 - RNA, 19 nt, Artificial Sequence
  Synthetic oligonucleotide
cuuuuuaaauggaugcuaa

SEQ ID NO: 19433 - RNA, 19 nt, Artificial Sequence
  Synthetic oligonucleotide
uuuuuaaauggaugcuaaa

SEQ ID NO: 19434 - RNA, 19 nt, Artificial Sequence
  Synthetic oligonucleotide
uuuuaaauggaugcuaaaa

SEQ ID NO: 19435 - RNA, 19 nt, Artificial Sequence
  Synthetic oligonucleotide
uuuaaauggaugcuaaaau

SEQ ID NO: 19436 - RNA, 19 nt, Artificial Sequence
  Synthetic oligonucleotide
uuaaauggaugcuaaaauu

SEQ ID NO: 19437 - RNA, 19 nt, Artificial Sequence
  Synthetic oligonucleotide
uaaauggaugcuaaaauuc

SEQ ID NO: 19438 - RNA, 19 nt, Artificial Sequence
  Synthetic oligonucleotide
aaauggaugcuaaaauucc

SEQ ID NO: 19439 - RNA, 19 nt, Artificial Sequence
  Synthetic oligonucleotide
aauggaugcuaaaauuccu

SEQ ID NO: 19440 - RNA, 19 nt, Artificial Sequence
  Synthetic oligonucleotide
uggaugcuaaaauuccuga

SEQ ID NO: 19441 - RNA, 19 nt, Artificial Sequence
  Synthetic oligonucleotide
ggaugcuaaaauuccugaa

SEQ ID NO: 19442 - RNA, 19 nt, Artificial Sequence
  Synthetic oligonucleotide
gaugcuaaaauuccugaag

SEQ ID NO: 19443 - RNA, 19 nt, Artificial Sequence
  Synthetic oligonucleotide
augcuaaaauuccugaagu

SEQ ID NO: 19444 - RNA, 19 nt, Artificial Sequence
  Synthetic oligonucleotide
ugcuaaaauuccugaaguu

SEQ ID NO: 19445 - RNA, 19 nt, Artificial Sequence
  Synthetic oligonucleotide
gcuaaaauuccugaaguuc

SEQ ID NO: 19446 - RNA, 19 nt, Artificial Sequence
  Synthetic oligonucleotide
cuaaaauuccugaaguuca

SEQ ID NO: 19447 - RNA, 19 nt, Artificial Sequence
  Synthetic oligonucleotide
uaaaauuccugaaguucag

SEQ ID NO: 19448 - RNA, 19 nt, Artificial Sequence
  Synthetic oligonucleotide
aaaauuccugaaguucagc

SEQ ID NO: 19449 - RNA, 19 nt, Artificial Sequence
  Synthetic oligonucleotide
aaauuccugaaguucagcu

SEQ ID NO: 19450 - RNA, 19 nt, Artificial Sequence
  Synthetic oligonucleotide
aauuccugaaguucagcug

SEQ ID NO: 19451 - RNA, 19 nt, Artificial Sequence
  Synthetic oligonucleotide
auuccugaaguucagcugc

SEQ ID NO: 19452 - RNA, 19 nt, Artificial Sequence
  Synthetic oligonucleotide
uuccugaaguucagcugca

SEQ ID NO: 19453 - RNA, 19 nt, Artificial Sequence
  Synthetic oligonucleotide
uccugaaguucagcugcau

SEQ ID NO: 19454 - RNA, 19 nt, Artificial Sequence
  Synthetic oligonucleotide
ccugaaguucagcugcaua

SEQ ID NO: 19455 - RNA, 19 nt, Artificial Sequence
  Synthetic oligonucleotide
cugaaguucagcugcauac

SEQ ID NO: 19456 - RNA, 19 nt, Artificial Sequence
  Synthetic oligonucleotide
ugaaguucagcugcauaca

SEQ ID NO: 19457 - RNA, 19 nt, Artificial Sequence
  Synthetic oligonucleotide
gaaguucagcugcauacag

SEQ ID NO: 19458 - RNA, 19 nt, Artificial Sequence
  Synthetic oligonucleotide
aaguucagcugcauacagu

SEQ ID NO: 19459 - RNA, 19 nt, Artificial Sequence
  Synthetic oligonucleotide
aguucagcugcauacaguu

SEQ ID NO: 19460 - RNA, 19 nt, Artificial Sequence
  Synthetic oligonucleotide
guucagcugcauacaguuu

SEQ ID NO: 19461 - RNA, 19 nt, Artificial Sequence
  Synthetic oligonucleotide
uucagcugcauacaguuug

SEQ ID NO: 19462 - RNA, 19 nt, Artificial Sequence
  Synthetic oligonucleotide
ucagcugcauacaguuugc

SEQ ID NO: 19463 - RNA, 19 nt, Artificial Sequence
  Synthetic oligonucleotide
cagcugcauacaguuugca

SEQ ID NO: 19464 - RNA, 19 nt, Artificial Sequence
  Synthetic oligonucleotide
agcugcauacaguuugcac

SEQ ID NO: 19465 - RNA, 19 nt, Artificial Sequence
  Synthetic oligonucleotide
gcugcauacaguuugcacu

SEQ ID NO: 19466 - RNA, 19 nt, Artificial Sequence
  Synthetic oligonucleotide
cugcauacaguuugcacuu

SEQ ID NO: 19467 - RNA, 19 nt, Artificial Sequence
  Synthetic oligonucleotide
ugcauacaguuugcacuua

SEQ ID NO: 19468 - RNA, 19 nt, Artificial Sequence
  Synthetic oligonucleotide
gcauacaguuugcacuuau

SEQ ID NO: 19469 - RNA, 19 nt, Artificial Sequence
  Synthetic oligonucleotide
cauacaguuugcacuuaug

SEQ ID NO: 19470 - RNA, 19 nt, Artificial Sequence
  Synthetic oligonucleotide
auacaguuugcacuuaugg

SEQ ID NO: 19471 - RNA, 19 nt, Artificial Sequence
  Synthetic oligonucleotide
uacaguuugcacuuaugga

SEQ ID NO: 19472 - RNA, 19 nt, Artificial Sequence
  Synthetic oligonucleotide
acaguuugcacuuauggac

SEQ ID NO: 19473 - RNA, 19 nt, Artificial Sequence
  Synthetic oligonucleotide
caguuugcacuuauggacu

SEQ ID NO: 19474 - RNA, 19 nt, Artificial Sequence
  Synthetic oligonucleotide
aguuugcacuuauggacuc

SEQ ID NO: 19475 - RNA, 19 nt, Artificial Sequence
  Synthetic oligonucleotide
guuugcacuuauggacucc

SEQ ID NO: 19476 - RNA, 19 nt, Artificial Sequence
  Synthetic oligonucleotide
uuugcacuuauggacuccu

SEQ ID NO: 19477 - RNA, 19 nt, Artificial Sequence
  Synthetic oligonucleotide
uugcacuuauggacuccug

SEQ ID NO: 19478 - RNA, 19 nt, Artificial Sequence
  Synthetic oligonucleotide
ugcacuuauggacuccugu

SEQ ID NO: 19479 - RNA, 19 nt, Artificial Sequence
  Synthetic oligonucleotide
gcacuuauggacuccuguu

SEQ ID NO: 19480 - RNA, 19 nt, Artificial Sequence
  Synthetic oligonucleotide
cacuuauggacuccuguug

SEQ ID NO: 19481 - RNA, 19 nt, Artificial Sequence
  Synthetic oligonucleotide
acuuauggacuccuguugu

SEQ ID NO: 19482 - RNA, 19 nt, Artificial Sequence
  Synthetic oligonucleotide
cuuauggacuccuguuguu

SEQ ID NO: 19483 - RNA, 19 nt, Artificial Sequence
  Synthetic oligonucleotide
uuauggacuccuguuguug

SEQ ID NO: 19484 - RNA, 19 nt, Artificial Sequence
  Synthetic oligonucleotide
auggacuccuguuguugaa

SEQ ID NO: 19485 - RNA, 19 nt, Artificial Sequence
  Synthetic oligonucleotide
uagcuggucuuauuuguaa

SEQ ID NO: 19486 - RNA, 19 nt, Artificial Sequence
  Synthetic oligonucleotide
agcuggucuuauuuguaaa

SEQ ID NO: 19487 - RNA, 19 nt, Artificial Sequence
  Synthetic oligonucleotide
gcuggucuuauuuguaaag

SEQ ID NO: 19488 - RNA, 19 nt, Artificial Sequence
  Synthetic oligonucleotide
cuggucuuauuuguaaagc

SEQ ID NO: 19489 - RNA, 19 nt, Artificial Sequence
  Synthetic oligonucleotide
uggucuuauuuguaaagcu

SEQ ID NO: 19490 - RNA, 19 nt, Artificial Sequence
  Synthetic oligonucleotide
ggucuuauuuguaaagcuc

SEQ ID NO: 19491 - RNA, 19 nt, Artificial Sequence
  Synthetic oligonucleotide
gucuuauuuguaaagcuca

SEQ ID NO: 19492 - RNA, 19 nt, Artificial Sequence
  Synthetic oligonucleotide
ucuuauuuguaaagcucac

SEQ ID NO: 19493 - RNA, 19 nt, Artificial Sequence
  Synthetic oligonucleotide
cuuauuuguaaagcucacu

SEQ ID NO: 19494 - RNA, 19 nt, Artificial Sequence
  Synthetic oligonucleotide
uuauuuguaaagcucacuu

SEQ ID NO: 19495 - RNA, 19 nt, Artificial Sequence
  Synthetic oligonucleotide
uauuuguaaagcucacuuu

SEQ ID NO: 19496 - RNA, 19 nt, Artificial Sequence
  Synthetic oligonucleotide
auuuguaaagcucacuuua

SEQ ID NO: 19497 - RNA, 19 nt, Artificial Sequence
  Synthetic oligonucleotide
uuuguaaagcucacuuuac

SEQ ID NO: 19498 - RNA, 19 nt, Artificial Sequence
  Synthetic oligonucleotide
uuguaaagcucacuuuacu

SEQ ID NO: 19499 - RNA, 19 nt, Artificial Sequence
  Synthetic oligonucleotide
uguaaagcucacuuuacuu

SEQ ID NO: 19500 - RNA, 19 nt, Artificial Sequence
  Synthetic oligonucleotide
guaaagcucacuuuacuua

SEQ ID NO: 19501 - RNA, 19 nt, Artificial Sequence
  Synthetic oligonucleotide
uaaagcucacuuuacuuag

SEQ ID NO: 19502 - RNA, 19 nt, Artificial Sequence
  Synthetic oligonucleotide
aaagcucacuuuacuuaga

SEQ ID NO: 19503 - RNA, 19 nt, Artificial Sequence
  Synthetic oligonucleotide
aagcucacuuuacuuagaa

SEQ ID NO: 19504 - RNA, 19 nt, Artificial Sequence
  Synthetic oligonucleotide
agcucacuuuacuuagaau

SEQ ID NO: 19505 - RNA, 19 nt, Artificial Sequence
  Synthetic oligonucleotide
gcucacuuuacuuagaauu

SEQ ID NO: 19506 - RNA, 19 nt, Artificial Sequence
  Synthetic oligonucleotide
cucacuuuacuuagaauua

SEQ ID NO: 19507 - RNA, 19 nt, Artificial Sequence
  Synthetic oligonucleotide
ucacuuuacuuagaauuag

SEQ ID NO: 19508 - RNA, 19 nt, Artificial Sequence
  Synthetic oligonucleotide
cacuuuacuuagaauuagu

SEQ ID NO: 19509 - RNA, 19 nt, Artificial Sequence
  Synthetic oligonucleotide
acuuuacuuagaauuagug

SEQ ID NO: 19510 - RNA, 19 nt, Artificial Sequence
  Synthetic oligonucleotide
cuuuacuuagaauuagugg

SEQ ID NO: 19511 - RNA, 19 nt, Artificial Sequence
  Synthetic oligonucleotide
uuuacuuagaauuaguggc

SEQ ID NO: 19512 - RNA, 19 nt, Artificial Sequence
  Synthetic oligonucleotide
uuacuuagaauuaguggca

SEQ ID NO: 19513 - RNA, 19 nt, Artificial Sequence
  Synthetic oligonucleotide
uacuuagaauuaguggcac

SEQ ID NO: 19514 - RNA, 19 nt, Artificial Sequence
  Synthetic oligonucleotide
acuuagaauuaguggcacu

SEQ ID NO: 19515 - RNA, 19 nt, Artificial Sequence
  Synthetic oligonucleotide
cuuagaauuaguggcacuu

SEQ ID NO: 19516 - RNA, 19 nt, Artificial Sequence
  Synthetic oligonucleotide
uuagaauuaguggcacuug

SEQ ID NO: 19517 - RNA, 19 nt, Artificial Sequence
  Synthetic oligonucleotide
uagaauuaguggcacuugc

SEQ ID NO: 19518 - RNA, 19 nt, Artificial Sequence
  Synthetic oligonucleotide
agaauuaguggcacuugcu

SEQ ID NO: 19519 - RNA, 19 nt, Artificial Sequence
  Synthetic oligonucleotide
gaauuaguggcacuugcuu

SEQ ID NO: 19520 - RNA, 19 nt, Artificial Sequence
  Synthetic oligonucleotide
aauuaguggcacuugcuuu

SEQ ID NO: 19521 - RNA, 19 nt, Artificial Sequence
  Synthetic oligonucleotide
auuaguggcacuugcuuuu

SEQ ID NO: 19522 - RNA, 19 nt, Artificial Sequence
  Synthetic oligonucleotide
uuaguggcacuugcuuuua

SEQ ID NO: 19523 - RNA, 19 nt, Artificial Sequence
  Synthetic oligonucleotide
uaguggcacuugcuuuuau

SEQ ID NO: 19524 - RNA, 19 nt, Artificial Sequence
  Synthetic oligonucleotide
aguggcacuugcuuuuauu

SEQ ID NO: 19525 - RNA, 19 nt, Artificial Sequence
  Synthetic oligonucleotide
guggcacuugcuuuuauua

SEQ ID NO: 19526 - RNA, 19 nt, Artificial Sequence
  Synthetic oligonucleotide
uggcacuugcuuuuauuag

SEQ ID NO: 19527 - RNA, 19 nt, Artificial Sequence
  Synthetic oligonucleotide
ggcacuugcuuuuauuaga

SEQ ID NO: 19528 - RNA, 19 nt, Artificial Sequence
  Synthetic oligonucleotide
gcacuugcuuuuauuagag

SEQ ID NO: 19529 - RNA, 19 nt, Artificial Sequence
  Synthetic oligonucleotide
cacuugcuuuuauuagaga

SEQ ID NO: 19530 - RNA, 19 nt, Artificial Sequence
  Synthetic oligonucleotide
acuugcuuuuauuagagaa

SEQ ID NO: 19531 - RNA, 19 nt, Artificial Sequence
  Synthetic oligonucleotide
cuuuuauuagagaaugauu

SEQ ID NO: 19532 - RNA, 19 nt, Artificial Sequence
  Synthetic oligonucleotide
ugcuguaacuuucugaaau

SEQ ID NO: 19533 - RNA, 19 nt, Artificial Sequence
  Synthetic oligonucleotide
gcuguaacuuucugaaaua

SEQ ID NO: 19534 - RNA, 19 nt, Artificial Sequence
  Synthetic oligonucleotide
cuguaacuuucugaaauaa

SEQ ID NO: 19535 - RNA, 19 nt, Artificial Sequence
  Synthetic oligonucleotide
uguaacuuucugaaauaac

SEQ ID NO: 19536 - RNA, 19 nt, Artificial Sequence
  Synthetic oligonucleotide
guaacuuucugaaauaaca

SEQ ID NO: 19537 - RNA, 19 nt, Artificial Sequence
  Synthetic oligonucleotide
uaacuuucugaaauaacau

SEQ ID NO: 19538 - RNA, 19 nt, Artificial Sequence
  Synthetic oligonucleotide
aacuuucugaaauaacaug

SEQ ID NO: 19539 - RNA, 19 nt, Artificial Sequence
  Synthetic oligonucleotide
acuuucugaaauaacaugg

SEQ ID NO: 19540 - RNA, 19 nt, Artificial Sequence
  Synthetic oligonucleotide
cuuucugaaauaacauggc

SEQ ID NO: 19541 - RNA, 19 nt, Artificial Sequence
  Synthetic oligonucleotide
uuucugaaauaacauggcc

SEQ ID NO: 19542 - RNA, 19 nt, Artificial Sequence
  Synthetic oligonucleotide
uucugaaauaacauggccu

SEQ ID NO: 19543 - RNA, 19 nt, Artificial Sequence
  Synthetic oligonucleotide
ucugaaauaacauggccuu

SEQ ID NO: 19544 - RNA, 19 nt, Artificial Sequence
  Synthetic oligonucleotide
cugaaauaacauggccuug

SEQ ID NO: 19545 - RNA, 19 nt, Artificial Sequence
  Synthetic oligonucleotide
ugaaauaacauggccuugg

SEQ ID NO: 19546 - RNA, 19 nt, Artificial Sequence
  Synthetic oligonucleotide
gaaauaacauggccuugga

SEQ ID NO: 19547 - RNA, 19 nt, Artificial Sequence
  Synthetic oligonucleotide
aaauaacauggccuuggag

SEQ ID NO: 19548 - RNA, 19 nt, Artificial Sequence
  Synthetic oligonucleotide
aauaacauggccuuggagg

SEQ ID NO: 19549 - RNA, 19 nt, Artificial Sequence
  Synthetic oligonucleotide
auaacauggccuuggaggg

SEQ ID NO: 19550 - RNA, 19 nt, Artificial Sequence
  Synthetic oligonucleotide
uaacauggccuuggagggc

SEQ ID NO: 19551 - RNA, 19 nt, Artificial Sequence
  Synthetic oligonucleotide
aacauggccuuggagggca

SEQ ID NO: 19552 - RNA, 19 nt, Artificial Sequence
  Synthetic oligonucleotide
acauggccuuggagggcau

SEQ ID NO: 19553 - RNA, 19 nt, Artificial Sequence
  Synthetic oligonucleotide
cauggccuuggagggcaug

SEQ ID NO: 19554 - RNA, 19 nt, Artificial Sequence
  Synthetic oligonucleotide
auggccuuggagggcauga

SEQ ID NO: 19555 - RNA, 19 nt, Artificial Sequence
  Synthetic oligonucleotide
uggccuuggagggcaugaa

SEQ ID NO: 19556 - RNA, 19 nt, Artificial Sequence
  Synthetic oligonucleotide
ggccuuggagggcaugaag

SEQ ID NO: 19557 - RNA, 19 nt, Artificial Sequence
  Synthetic oligonucleotide
gccuuggagggcaugaaga

SEQ ID NO: 19558 - RNA, 19 nt, Artificial Sequence
  Synthetic oligonucleotide
ccuuggagggcaugaagac

SEQ ID NO: 19559 - RNA, 19 nt, Artificial Sequence
  Synthetic oligonucleotide
cuuggagggcaugaagaca

SEQ ID NO: 19560 - RNA, 19 nt, Artificial Sequence
  Synthetic oligonucleotide
uuggagggcaugaagacag

SEQ ID NO: 19561 - RNA, 19 nt, Artificial Sequence
  Synthetic oligonucleotide
uggagggcaugaagacaga

SEQ ID NO: 19562 - RNA, 19 nt, Artificial Sequence
  Synthetic oligonucleotide
ggagggcaugaagacagau

SEQ ID NO: 19563 - RNA, 19 nt, Artificial Sequence
  Synthetic oligonucleotide
gagggcaugaagacagaua

SEQ ID NO: 19564 - RNA, 19 nt, Artificial Sequence
  Synthetic oligonucleotide
agggcaugaagacagauac

SEQ ID NO: 19565 - RNA, 19 nt, Artificial Sequence
  Synthetic oligonucleotide
gggcaugaagacagauacu

SEQ ID NO: 19566 - RNA, 19 nt, Artificial Sequence
  Synthetic oligonucleotide
ggcaugaagacagauacuc

SEQ ID NO: 19567 - RNA, 19 nt, Artificial Sequence
  Synthetic oligonucleotide
gcaugaagacagauacucc

SEQ ID NO: 19568 - RNA, 19 nt, Artificial Sequence
  Synthetic oligonucleotide
caugaagacagauacuccu

SEQ ID NO: 19569 - RNA, 19 nt, Artificial Sequence
  Synthetic oligonucleotide
augaagacagauacuccuc

SEQ ID NO: 19570 - RNA, 19 nt, Artificial Sequence
  Synthetic oligonucleotide
ugaagacagauacuccucc

SEQ ID NO: 19571 - RNA, 19 nt, Artificial Sequence
  Synthetic oligonucleotide
gaagacagauacuccucca

SEQ ID NO: 19572 - RNA, 19 nt, Artificial Sequence
  Synthetic oligonucleotide
aagacagauacuccuccaa

SEQ ID NO: 19573 - RNA, 19 nt, Artificial Sequence
  Synthetic oligonucleotide
agacagauacuccuccaag

SEQ ID NO: 19574 - RNA, 19 nt, Artificial Sequence
  Synthetic oligonucleotide
gacagauacuccuccaagg

SEQ ID NO: 19575 - RNA, 19 nt, Artificial Sequence
  Synthetic oligonucleotide
cagauacuccuccaagguu

SEQ ID NO: 19576 - RNA, 19 nt, Artificial Sequence
  Synthetic oligonucleotide
agauacuccuccaagguua

SEQ ID NO: 19577 - RNA, 19 nt, Artificial Sequence
  Synthetic oligonucleotide
gauacuccuccaagguuau

SEQ ID NO: 19578 - RNA, 19 nt, Artificial Sequence
  Synthetic oligonucleotide
auacuccuccaagguuauu

SEQ ID NO: 19579 - RNA, 19 nt, Artificial Sequence
  Synthetic oligonucleotide
uacuccuccaagguuauug

SEQ ID NO: 19580 - RNA, 19 nt, Artificial Sequence
  Synthetic oligonucleotide
acuccuccaagguuauugg

SEQ ID NO: 19581 - RNA, 19 nt, Artificial Sequence
  Synthetic oligonucleotide
cuccuccaagguuauugga

SEQ ID NO: 19582 - RNA, 19 nt, Artificial Sequence
  Synthetic oligonucleotide
uccuccaagguuauuggac

SEQ ID NO: 19583 - RNA, 19 nt, Artificial Sequence
  Synthetic oligonucleotide
ccuccaagguuauuggaca

SEQ ID NO: 19584 - RNA, 19 nt, Artificial Sequence
  Synthetic oligonucleotide
cuccaagguuauuggacac

SEQ ID NO: 19585 - RNA, 19 nt, Artificial Sequence
  Synthetic oligonucleotide
uccaagguuauuggacacc

SEQ ID NO: 19586 - RNA, 19 nt, Artificial Sequence
  Synthetic oligonucleotide
ccaagguuauuggacaccg

SEQ ID NO: 19587 - RNA, 19 nt, Artificial Sequence
  Synthetic oligonucleotide
caagguuauuggacaccgg

SEQ ID NO: 19588 - RNA, 19 nt, Artificial Sequence
  Synthetic oligonucleotide
aagguuauuggacaccgga

SEQ ID NO: 19589 - RNA, 19 nt, Artificial Sequence
  Synthetic oligonucleotide
agguuauuggacaccggaa

SEQ ID NO: 19590 - RNA, 19 nt, Artificial Sequence
  Synthetic oligonucleotide
gguuauuggacaccggaaa

SEQ ID NO: 19591 - RNA, 19 nt, Artificial Sequence
  Synthetic oligonucleotide
guuauuggacaccggaaac

SEQ ID NO: 19592 - RNA, 19 nt, Artificial Sequence
  Synthetic oligonucleotide
uuauuggacaccggaaaca

SEQ ID NO: 19593 - RNA, 19 nt, Artificial Sequence
  Synthetic oligonucleotide
uauuggacaccggaaacaa

SEQ ID NO: 19594 - RNA, 19 nt, Artificial Sequence
  Synthetic oligonucleotide
auuggacaccggaaacaau

SEQ ID NO: 19595 - RNA, 19 nt, Artificial Sequence
  Synthetic oligonucleotide
uuggacaccggaaacaaua

SEQ ID NO: 19596 - RNA, 19 nt, Artificial Sequence
  Synthetic oligonucleotide
uggacaccggaaacaauaa

SEQ ID NO: 19597 - RNA, 19 nt, Artificial Sequence
  Synthetic oligonucleotide
ggacaccggaaacaauaaa

SEQ ID NO: 19598 - RNA, 19 nt, Artificial Sequence
  Synthetic oligonucleotide
gacaccggaaacaauaaau

SEQ ID NO: 19599 - RNA, 19 nt, Artificial Sequence
  Synthetic oligonucleotide
ggaacaccuccucaaaccu

SEQ ID NO: 19600 - RNA, 19 nt, Artificial Sequence
  Synthetic oligonucleotide
gaacaccuccucaaaccua

SEQ ID NO: 19601 - RNA, 19 nt, Artificial Sequence
  Synthetic oligonucleotide
aacaccuccucaaaccuac

SEQ ID NO: 19602 - RNA, 19 nt, Artificial Sequence
  Synthetic oligonucleotide
acaccuccucaaaccuacc

SEQ ID NO: 19603 - RNA, 19 nt, Artificial Sequence
  Synthetic oligonucleotide
caccuccucaaaccuacca

SEQ ID NO: 19604 - RNA, 19 nt, Artificial Sequence
  Synthetic oligonucleotide
accuccucaaaccuaccac

SEQ ID NO: 19605 - RNA, 19 nt, Artificial Sequence
  Synthetic oligonucleotide
ggccgaaagaacaguccau

SEQ ID NO: 19606 - RNA, 19 nt, Artificial Sequence
  Synthetic oligonucleotide
gccgaaagaacaguccauu

SEQ ID NO: 19607 - RNA, 19 nt, Artificial Sequence
  Synthetic oligonucleotide
ccgaaagaacaguccauug

SEQ ID NO: 19608 - RNA, 19 nt, Artificial Sequence
  Synthetic oligonucleotide
cgaaagaacaguccauuga

SEQ ID NO: 19609 - RNA, 19 nt, Artificial Sequence
  Synthetic oligonucleotide
gaaagaacaguccauugaa

SEQ ID NO: 19610 - RNA, 19 nt, Artificial Sequence
  Synthetic oligonucleotide
gggaguauuacaaaaacau

SEQ ID NO: 19611 - RNA, 19 nt, Artificial Sequence
  Synthetic oligonucleotide
ggaguauuacaaaaacaug

SEQ ID NO: 19612 - RNA, 19 nt, Artificial Sequence
  Synthetic oligonucleotide
gaguauuacaaaaacaugg

SEQ ID NO: 19613 - RNA, 19 nt, Artificial Sequence
  Synthetic oligonucleotide
aguauuacaaaaacauggc

SEQ ID NO: 19614 - RNA, 19 nt, Artificial Sequence
  Synthetic oligonucleotide
guauuacaaaaacauggcc

SEQ ID NO: 19615 - RNA, 19 nt, Artificial Sequence
  Synthetic oligonucleotide
uauuacaaaaacauggccu

SEQ ID NO: 19616 - RNA, 19 nt, Artificial Sequence
  Synthetic oligonucleotide
auuacaaaaacauggccuu

SEQ ID NO: 19617 - RNA, 19 nt, Artificial Sequence
  Synthetic oligonucleotide
uuacaaaaacauggccuuu

SEQ ID NO: 19618 - RNA, 19 nt, Artificial Sequence
  Synthetic oligonucleotide
uacaaaaacauggccuuug

SEQ ID NO: 19619 - RNA, 19 nt, Artificial Sequence
  Synthetic oligonucleotide
acaaaaacauggccuuugc

SEQ ID NO: 19620 - RNA, 19 nt, Artificial Sequence
  Synthetic oligonucleotide
caaaaacauggccuuugcu

SEQ ID NO: 19621 - RNA, 19 nt, Artificial Sequence
  Synthetic oligonucleotide
aaaaacauggccuuugcuu

SEQ ID NO: 19622 - RNA, 19 nt, Artificial Sequence
  Synthetic oligonucleotide
aaaacauggccuuugcuug

SEQ ID NO: 19623 - RNA, 19 nt, Artificial Sequence
  Synthetic oligonucleotide
aaacauggccuuugcuuga

SEQ ID NO: 19624 - RNA, 19 nt, Artificial Sequence
  Synthetic oligonucleotide
aacauggccuuugcuugaa

SEQ ID NO: 19625 - RNA, 19 nt, Artificial Sequence
  Synthetic oligonucleotide
acauggccuuugcuugaaa

SEQ ID NO: 19626 - RNA, 19 nt, Artificial Sequence
  Synthetic oligonucleotide
cauggccuuugcuugaaag

SEQ ID NO: 19627 - RNA, 19 nt, Artificial Sequence
  Synthetic oligonucleotide
auggccuuugcuugaaaga

SEQ ID NO: 19628 - RNA, 19 nt, Artificial Sequence
  Synthetic oligonucleotide
uggccuuugcuugaaagaa

SEQ ID NO: 19629 - RNA, 19 nt, Artificial Sequence
  Synthetic oligonucleotide
ggccuuugcuugaaagaaa

SEQ ID NO: 19630 - RNA, 19 nt, Artificial Sequence
  Synthetic oligonucleotide
gccuuugcuugaaagaaaa

SEQ ID NO: 19631 - RNA, 19 nt, Artificial Sequence
  Synthetic oligonucleotide
ccuuugcuugaaagaaaau

SEQ ID NO: 19632 - RNA, 19 nt, Artificial Sequence
  Synthetic oligonucleotide
cuuugcuugaaagaaaaua

SEQ ID NO: 19633 - RNA, 19 nt, Artificial Sequence
  Synthetic oligonucleotide
uuugcuugaaagaaaauac

SEQ ID NO: 19634 - RNA, 19 nt, Artificial Sequence
  Synthetic oligonucleotide
uugcuugaaagaaaauacc

SEQ ID NO: 19635 - RNA, 19 nt, Artificial Sequence
  Synthetic oligonucleotide
aacaggaaacugaucauua

SEQ ID NO: 19636 - RNA, 19 nt, Artificial Sequence
  Synthetic oligonucleotide
acaggaaacugaucauuaa

SEQ ID NO: 19637 - RNA, 19 nt, Artificial Sequence
  Synthetic oligonucleotide
caggaaacugaucauuaaa

SEQ ID NO: 19638 - RNA, 19 nt, Artificial Sequence
  Synthetic oligonucleotide
aggaaacugaucauuaaag

SEQ ID NO: 19639 - RNA, 19 nt, Artificial Sequence
  Synthetic oligonucleotide
ggaaacugaucauuaaagc

SEQ ID NO: 19640 - RNA, 19 nt, Artificial Sequence
  Synthetic oligonucleotide
gaaacugaucauuaaagcc

SEQ ID NO: 19641 - RNA, 19 nt, Artificial Sequence
  Synthetic oligonucleotide
aaacugaucauuaaagccu

SEQ ID NO: 19642 - RNA, 19 nt, Artificial Sequence
  Synthetic oligonucleotide
aacugaucauuaaagccug

SEQ ID NO: 19643 - RNA, 19 nt, Artificial Sequence
  Synthetic oligonucleotide
acugaucauuaaagccuga

SEQ ID NO: 19644 - RNA, 19 nt, Artificial Sequence
  Synthetic oligonucleotide
cugaucauuaaagccugag

SEQ ID NO: 19645 - RNA, 19 nt, Artificial Sequence
  Synthetic oligonucleotide
ugaucauuaaagccugagu

SEQ ID NO: 19646 - RNA, 19 nt, Artificial Sequence
  Synthetic oligonucleotide
gaucauuaaagccugaguu

SEQ ID NO: 19647 - RNA, 19 nt, Artificial Sequence
  Synthetic oligonucleotide
aucauuaaagccugaguuu

SEQ ID NO: 19648 - RNA, 19 nt, Artificial Sequence
  Synthetic oligonucleotide
auuaaagccugaguuugcu

SEQ ID NO: 19649 - RNA, 19 nt, Artificial Sequence
  Synthetic oligonucleotide
uuaaagccugaguuugcuu

SEQ ID NO: 19650 - RNA, 19 nt, Artificial Sequence
  Synthetic oligonucleotide
uccugcuaccuccaaccau

SEQ ID NO: 19651 - RNA, 19 nt, Artificial Sequence
  Synthetic oligonucleotide
ccugcuaccuccaaccaug

SEQ ID NO: 19652 - RNA, 19 nt, Artificial Sequence
  Synthetic oligonucleotide
cugcuaccuccaaccaugg

SEQ ID NO: 19653 - RNA, 19 nt, Artificial Sequence
  Synthetic oligonucleotide
ugcuaccuccaaccauggg

SEQ ID NO: 19654 - RNA, 19 nt, Artificial Sequence
  Synthetic oligonucleotide
uaccuccaaccaugggccu

SEQ ID NO: 19655 - RNA, 19 nt, Artificial Sequence
  Synthetic oligonucleotide
accuccaaccaugggccuu

SEQ ID NO: 19656 - RNA, 19 nt, Artificial Sequence
  Synthetic oligonucleotide
ccuccaaccaugggccuuu

SEQ ID NO: 19657 - RNA, 19 nt, Artificial Sequence
  Synthetic oligonucleotide
cuccaaccaugggccuuuu

SEQ ID NO: 19658 - RNA, 19 nt, Artificial Sequence
  Synthetic oligonucleotide
uccaaccaugggccuuuug

SEQ ID NO: 19659 - RNA, 19 nt, Artificial Sequence
  Synthetic oligonucleotide
ccaaccaugggccuuuugg

SEQ ID NO: 19660 - RNA, 19 nt, Artificial Sequence
  Synthetic oligonucleotide
caaccaugggccuuuuggg

SEQ ID NO: 19661 - RNA, 19 nt, Artificial Sequence
  Synthetic oligonucleotide
aaccaugggccuuuuggga

SEQ ID NO: 19662 - RNA, 19 nt, Artificial Sequence
  Synthetic oligonucleotide
accaugggccuuuugggaa

SEQ ID NO: 19663 - RNA, 19 nt, Artificial Sequence
  Synthetic oligonucleotide
ccaugggccuuuugggaau

SEQ ID NO: 19664 - RNA, 19 nt, Artificial Sequence
  Synthetic oligonucleotide
caugggccuuuugggaaua

SEQ ID NO: 19665 - RNA, 19 nt, Artificial Sequence
  Synthetic oligonucleotide
augggccuuuugggaauac

SEQ ID NO: 19666 - RNA, 19 nt, Artificial Sequence
  Synthetic oligonucleotide
ugggccuuuugggaauacu

SEQ ID NO: 19667 - RNA, 19 nt, Artificial Sequence
  Synthetic oligonucleotide
gggccuuuugggaauacuu

SEQ ID NO: 19668 - RNA, 19 nt, Artificial Sequence
  Synthetic oligonucleotide
ggccuuuugggaauacuuu

SEQ ID NO: 19669 - RNA, 19 nt, Artificial Sequence
  Synthetic oligonucleotide
gccuuuugggaauacuuug

SEQ ID NO: 19670 - RNA, 19 nt, Artificial Sequence
  Synthetic oligonucleotide
ccuuuugggaauacuuugu

SEQ ID NO: 19671 - RNA, 19 nt, Artificial Sequence
  Synthetic oligonucleotide
cuuuugggaauacuuuguu

SEQ ID NO: 19672 - RNA, 19 nt, Artificial Sequence
  Synthetic oligonucleotide
uuuugggaauacuuuguuu

SEQ ID NO: 19673 - RNA, 19 nt, Artificial Sequence
  Synthetic oligonucleotide
uuugggaauacuuuguuuu

SEQ ID NO: 19674 - RNA, 19 nt, Artificial Sequence
  Synthetic oligonucleotide
uugggaauacuuuguuuuu

SEQ ID NO: 19675 - RNA, 19 nt, Artificial Sequence
  Synthetic oligonucleotide
ugggaauacuuuguuuuuu

SEQ ID NO: 19676 - RNA, 19 nt, Artificial Sequence
  Synthetic oligonucleotide
gggaauacuuuguuuuuua

SEQ ID NO: 19677 - RNA, 19 nt, Artificial Sequence
  Synthetic oligonucleotide
ggaauacuuuguuuuuuaa

SEQ ID NO: 19678 - RNA, 19 nt, Artificial Sequence
  Synthetic oligonucleotide
gaauacuuuguuuuuuaau

SEQ ID NO: 19679 - RNA, 19 nt, Artificial Sequence
  Synthetic oligonucleotide
aauacuuuguuuuuuaauc

SEQ ID NO: 19680 - RNA, 19 nt, Artificial Sequence
  Synthetic oligonucleotide
auacuuuguuuuuuaaucu

SEQ ID NO: 19681 - RNA, 19 nt, Artificial Sequence
  Synthetic oligonucleotide
uacuuuguuuuuuaaucuu

SEQ ID NO: 19682 - RNA, 19 nt, Artificial Sequence
  Synthetic oligonucleotide
acuuuguuuuuuaaucuuc

SEQ ID NO: 19683 - RNA, 19 nt, Artificial Sequence
  Synthetic oligonucleotide
cuuuguuuuuuaaucuucc

SEQ ID NO: 19684 - RNA, 19 nt, Artificial Sequence
  Synthetic oligonucleotide
uuuguuuuuuaaucuuccu

SEQ ID NO: 19685 - RNA, 19 nt, Artificial Sequence
  Synthetic oligonucleotide
uuguuuuuuaaucuuccug

SEQ ID NO: 19686 - RNA, 19 nt, Artificial Sequence
  Synthetic oligonucleotide
ccuggggacaggagcaaac

SEQ ID NO: 19687 - RNA, 19 nt, Artificial Sequence
  Synthetic oligonucleotide
cuggggacaggagcaaaca

SEQ ID NO: 19688 - RNA, 19 nt, Artificial Sequence
  Synthetic oligonucleotide
uggggacaggagcaaacau

SEQ ID NO: 19689 - RNA, 19 nt, Artificial Sequence
  Synthetic oligonucleotide
ggggacaggagcaaacaua

SEQ ID NO: 19690 - RNA, 19 nt, Artificial Sequence
  Synthetic oligonucleotide
gggacaggagcaaacauau

SEQ ID NO: 19691 - RNA, 19 nt, Artificial Sequence
  Synthetic oligonucleotide
ggacaggagcaaacauaug

SEQ ID NO: 19692 - RNA, 19 nt, Artificial Sequence
  Synthetic oligonucleotide
gacaggagcaaacauaugu

SEQ ID NO: 19693 - RNA, 19 nt, Artificial Sequence
  Synthetic oligonucleotide
acaggagcaaacauauguc

SEQ ID NO: 19694 - RNA, 19 nt, Artificial Sequence
  Synthetic oligonucleotide
caggagcaaacauauguca

SEQ ID NO: 19695 - RNA, 19 nt, Artificial Sequence
  Synthetic oligonucleotide
aggagcaaacauaugucau

SEQ ID NO: 19696 - RNA, 19 nt, Artificial Sequence
  Synthetic oligonucleotide
ggagcaaacauaugucauu

SEQ ID NO: 19697 - RNA, 19 nt, Artificial Sequence
  Synthetic oligonucleotide
gagcaaacauaugucauuu

SEQ ID NO: 19698 - RNA, 19 nt, Artificial Sequence
  Synthetic oligonucleotide
agcaaacauaugucauuuc

SEQ ID NO: 19699 - RNA, 19 nt, Artificial Sequence
  Synthetic oligonucleotide
gcaaacauaugucauuuca

SEQ ID NO: 19700 - RNA, 19 nt, Artificial Sequence
  Synthetic oligonucleotide
caaacauaugucauuucag

SEQ ID NO: 19701 - RNA, 19 nt, Artificial Sequence
  Synthetic oligonucleotide
aaacauaugucauuucagc

SEQ ID NO: 19702 - RNA, 19 nt, Artificial Sequence
  Synthetic oligonucleotide
aacauaugucauuucagca

SEQ ID NO: 19703 - RNA, 19 nt, Artificial Sequence
  Synthetic oligonucleotide
cauaugucauuucagcacc

SEQ ID NO: 19704 - RNA, 19 nt, Artificial Sequence
  Synthetic oligonucleotide
auaugucauuucagcacca

SEQ ID NO: 19705 - RNA, 19 nt, Artificial Sequence
  Synthetic oligonucleotide
uaugucauuucagcaccaa

SEQ ID NO: 19706 - RNA, 19 nt, Artificial Sequence
  Synthetic oligonucleotide
augucauuucagcaccaaa

SEQ ID NO: 19707 - RNA, 19 nt, Artificial Sequence
  Synthetic oligonucleotide
ugucauuucagcaccaaaa

SEQ ID NO: 19708 - RNA, 19 nt, Artificial Sequence
  Synthetic oligonucleotide
gucauuucagcaccaaaaa

SEQ ID NO: 19709 - RNA, 19 nt, Artificial Sequence
  Synthetic oligonucleotide
ucauuucagcaccaaaaau

SEQ ID NO: 19710 - RNA, 19 nt, Artificial Sequence
  Synthetic oligonucleotide
cauuucagcaccaaaaaua

SEQ ID NO: 19711 - RNA, 19 nt, Artificial Sequence
  Synthetic oligonucleotide
auuucagcaccaaaaauau

SEQ ID NO: 19712 - RNA, 19 nt, Artificial Sequence
  Synthetic oligonucleotide
uuucagcaccaaaaauauu

SEQ ID NO: 19713 - RNA, 19 nt, Artificial Sequence
  Synthetic oligonucleotide
uucagcaccaaaaauauuc

SEQ ID NO: 19714 - RNA, 19 nt, Artificial Sequence
  Synthetic oligonucleotide
ucagcaccaaaaauauucc

SEQ ID NO: 19715 - RNA, 19 nt, Artificial Sequence
  Synthetic oligonucleotide
cagcaccaaaaauauuccg

SEQ ID NO: 19716 - RNA, 19 nt, Artificial Sequence
  Synthetic oligonucleotide
agcaccaaaaauauuccgu

SEQ ID NO: 19717 - RNA, 19 nt, Artificial Sequence
  Synthetic oligonucleotide
gcaccaaaaauauuccgug

SEQ ID NO: 19718 - RNA, 19 nt, Artificial Sequence
  Synthetic oligonucleotide
caccaaaaauauuccgugu

SEQ ID NO: 19719 - RNA, 19 nt, Artificial Sequence
  Synthetic oligonucleotide
accaaaaauauuccguguu

SEQ ID NO: 19720 - RNA, 19 nt, Artificial Sequence
  Synthetic oligonucleotide
ccaaaaauauuccguguug

SEQ ID NO: 19721 - RNA, 19 nt, Artificial Sequence
  Synthetic oligonucleotide
caaaaauauuccguguugg

SEQ ID NO: 19722 - RNA, 19 nt, Artificial Sequence
  Synthetic oligonucleotide
aaaaauauuccguguugga

SEQ ID NO: 19723 - RNA, 19 nt, Artificial Sequence
  Synthetic oligonucleotide
aaaauauuccguguuggag

SEQ ID NO: 19724 - RNA, 19 nt, Artificial Sequence
  Synthetic oligonucleotide
aaauauuccguguuggagc

SEQ ID NO: 19725 - RNA, 19 nt, Artificial Sequence
  Synthetic oligonucleotide
aauauuccguguuggagca

SEQ ID NO: 19726 - RNA, 19 nt, Artificial Sequence
  Synthetic oligonucleotide
auauuccguguuggagcau

SEQ ID NO: 19727 - RNA, 19 nt, Artificial Sequence
  Synthetic oligonucleotide
uauuccguguuggagcauc

SEQ ID NO: 19728 - RNA, 19 nt, Artificial Sequence
  Synthetic oligonucleotide
auuccguguuggagcaucu

SEQ ID NO: 19729 - RNA, 19 nt, Artificial Sequence
  Synthetic oligonucleotide
uuccguguuggagcaucug

SEQ ID NO: 19730 - RNA, 19 nt, Artificial Sequence
  Synthetic oligonucleotide
uccguguuggagcaucuga

SEQ ID NO: 19731 - RNA, 19 nt, Artificial Sequence
  Synthetic oligonucleotide
ccguguuggagcaucugaa

SEQ ID NO: 19732 - RNA, 19 nt, Artificial Sequence
  Synthetic oligonucleotide
aaguuuauggauacacuga

SEQ ID NO: 19733 - RNA, 19 nt, Artificial Sequence
  Synthetic oligonucleotide
uuuauggauacacugaagc

SEQ ID NO: 19734 - RNA, 19 nt, Artificial Sequence
  Synthetic oligonucleotide
uauggauacacugaagcau

SEQ ID NO: 19735 - RNA, 19 nt, Artificial Sequence
  Synthetic oligonucleotide
acugaagcauuugaugcaa

SEQ ID NO: 19736 - RNA, 19 nt, Artificial Sequence
  Synthetic oligonucleotide
ugaagcauuugaugcaaca

SEQ ID NO: 19737 - RNA, 19 nt, Artificial Sequence
  Synthetic oligonucleotide
aagcauuugaugcaacaau

SEQ ID NO: 19738 - RNA, 19 nt, Artificial Sequence
  Synthetic oligonucleotide
gcauuugaugcaacaaucu

SEQ ID NO: 19739 - RNA, 19 nt, Artificial Sequence
  Synthetic oligonucleotide
cauuugaugcaacaaucuc

SEQ ID NO: 19740 - RNA, 19 nt, Artificial Sequence
  Synthetic oligonucleotide
auuugaugcaacaaucucu

SEQ ID NO: 19741 - RNA, 19 nt, Artificial Sequence
  Synthetic oligonucleotide
augcaacaaucucuauuaa

SEQ ID NO: 19742 - RNA, 19 nt, Artificial Sequence
  Synthetic oligonucleotide
ugcaacaaucucuauuaaa

SEQ ID NO: 19743 - RNA, 19 nt, Artificial Sequence
  Synthetic oligonucleotide
gcaacaaucucuauuaaaa

SEQ ID NO: 19744 - RNA, 19 nt, Artificial Sequence
  Synthetic oligonucleotide
acaaucucuauuaaaaguu

SEQ ID NO: 19745 - RNA, 19 nt, Artificial Sequence
  Synthetic oligonucleotide
caaucucuauuaaaaguua

SEQ ID NO: 19746 - RNA, 19 nt, Artificial Sequence
  Synthetic oligonucleotide
aaucucuauuaaaaguuau

SEQ ID NO: 19747 - RNA, 19 nt, Artificial Sequence
  Synthetic oligonucleotide
aucucuauuaaaaguuauc

SEQ ID NO: 19748 - RNA, 19 nt, Artificial Sequence
  Synthetic oligonucleotide
ucucuauuaaaaguuaucc

SEQ ID NO: 19749 - RNA, 19 nt, Artificial Sequence
  Synthetic oligonucleotide
ucuauuaaaaguuauccug

SEQ ID NO: 19750 - RNA, 19 nt, Artificial Sequence
  Synthetic oligonucleotide
uauuaaaaguuauccugau

SEQ ID NO: 19751 - RNA, 19 nt, Artificial Sequence
  Synthetic oligonucleotide
auuaaaaguuauccugaua

SEQ ID NO: 19752 - RNA, 19 nt, Artificial Sequence
  Synthetic oligonucleotide
aaaaguuauccugauaaaa

SEQ ID NO: 19753 - RNA, 19 nt, Artificial Sequence
  Synthetic oligonucleotide
aaaguuauccugauaaaaa

SEQ ID NO: 19754 - RNA, 19 nt, Artificial Sequence
  Synthetic oligonucleotide
guuauccugauaaaaaauu

SEQ ID NO: 19755 - RNA, 19 nt, Artificial Sequence
  Synthetic oligonucleotide
uuauccugauaaaaaauuu

SEQ ID NO: 19756 - RNA, 19 nt, Artificial Sequence
  Synthetic oligonucleotide
uauccugauaaaaaauuua

SEQ ID NO: 19757 - RNA, 19 nt, Artificial Sequence
  Synthetic oligonucleotide
auccugauaaaaaauuuag

SEQ ID NO: 19758 - RNA, 19 nt, Artificial Sequence
  Synthetic oligonucleotide
uccugauaaaaaauuuagu

SEQ ID NO: 19759 - RNA, 19 nt, Artificial Sequence
  Synthetic oligonucleotide
ccugauaaaaaauuuaguu

SEQ ID NO: 19760 - RNA, 19 nt, Artificial Sequence
  Synthetic oligonucleotide
cugauaaaaaauuuaguua

SEQ ID NO: 19761 - RNA, 19 nt, Artificial Sequence
  Synthetic oligonucleotide
ugauaaaaaauuuaguuac

SEQ ID NO: 19762 - RNA, 19 nt, Artificial Sequence
  Synthetic oligonucleotide
gauaaaaaauuuaguuacu

SEQ ID NO: 19763 - RNA, 19 nt, Artificial Sequence
  Synthetic oligonucleotide
auaaaaaauuuaguuacuc

SEQ ID NO: 19764 - RNA, 19 nt, Artificial Sequence
  Synthetic oligonucleotide
uaaaaaauuuaguuacucc

SEQ ID NO: 19765 - RNA, 19 nt, Artificial Sequence
  Synthetic oligonucleotide
aaaaaauuuaguuacuccu

SEQ ID NO: 19766 - RNA, 19 nt, Artificial Sequence
  Synthetic oligonucleotide
aaaaauuuaguuacuccuc

SEQ ID NO: 19767 - RNA, 19 nt, Artificial Sequence
  Synthetic oligonucleotide
aaaauuuaguuacuccuca

SEQ ID NO: 19768 - RNA, 19 nt, Artificial Sequence
  Synthetic oligonucleotide
aaauuuaguuacuccucag

SEQ ID NO: 19769 - RNA, 19 nt, Artificial Sequence
  Synthetic oligonucleotide
aauuuaguuacuccucagg

SEQ ID NO: 19770 - RNA, 19 nt, Artificial Sequence
  Synthetic oligonucleotide
auuuaguuacuccucaggc

SEQ ID NO: 19771 - RNA, 19 nt, Artificial Sequence
  Synthetic oligonucleotide
uuuaguuacuccucaggcc

SEQ ID NO: 19772 - RNA, 19 nt, Artificial Sequence
  Synthetic oligonucleotide
uuaguuacuccucaggcca

SEQ ID NO: 19773 - RNA, 19 nt, Artificial Sequence
  Synthetic oligonucleotide
uaguuacuccucaggccau

SEQ ID NO: 19774 - RNA, 19 nt, Artificial Sequence
  Synthetic oligonucleotide
aguuacuccucaggccaug

SEQ ID NO: 19775 - RNA, 19 nt, Artificial Sequence
  Synthetic oligonucleotide
guuacuccucaggccaugu

SEQ ID NO: 19776 - RNA, 19 nt, Artificial Sequence
  Synthetic oligonucleotide
uuacuccucaggccauguu

SEQ ID NO: 19777 - RNA, 19 nt, Artificial Sequence
  Synthetic oligonucleotide
uacuccucaggccauguuc

SEQ ID NO: 19778 - RNA, 19 nt, Artificial Sequence
  Synthetic oligonucleotide
acuccucaggccauguuca

SEQ ID NO: 19779 - RNA, 19 nt, Artificial Sequence
  Synthetic oligonucleotide
cuccucaggccauguucau

SEQ ID NO: 19780 - RNA, 19 nt, Artificial Sequence
  Synthetic oligonucleotide
uccucaggccauguucauu

SEQ ID NO: 19781 - RNA, 19 nt, Artificial Sequence
  Synthetic oligonucleotide
ccucaggccauguucauuu

SEQ ID NO: 19782 - RNA, 19 nt, Artificial Sequence
  Synthetic oligonucleotide
cucaggccauguucauuua

SEQ ID NO: 19783 - RNA, 19 nt, Artificial Sequence
  Synthetic oligonucleotide
ucaggccauguucauuuau

SEQ ID NO: 19784 - RNA, 19 nt, Artificial Sequence
  Synthetic oligonucleotide
caggccauguucauuuauc

SEQ ID NO: 19785 - RNA, 19 nt, Artificial Sequence
  Synthetic oligonucleotide
aggccauguucauuuaucc

SEQ ID NO: 19786 - RNA, 19 nt, Artificial Sequence
  Synthetic oligonucleotide
ggccauguucauuuauccu

SEQ ID NO: 19787 - RNA, 19 nt, Artificial Sequence
  Synthetic oligonucleotide
gccauguucauuuauccuc

SEQ ID NO: 19788 - RNA, 19 nt, Artificial Sequence
  Synthetic oligonucleotide
ccauguucauuuauccuca

SEQ ID NO: 19789 - RNA, 19 nt, Artificial Sequence
  Synthetic oligonucleotide
cauguucauuuauccucag

SEQ ID NO: 19790 - RNA, 19 nt, Artificial Sequence
  Synthetic oligonucleotide
guucauuuauccucagaga

SEQ ID NO: 19791 - RNA, 19 nt, Artificial Sequence
  Synthetic oligonucleotide
uucauuuauccucagagaa

SEQ ID NO: 19792 - RNA, 19 nt, Artificial Sequence
  Synthetic oligonucleotide
ucauuuauccucagagaau

SEQ ID NO: 19793 - RNA, 19 nt, Artificial Sequence
  Synthetic oligonucleotide
cauuuauccucagagaaua

SEQ ID NO: 19794 - RNA, 19 nt, Artificial Sequence
  Synthetic oligonucleotide
auuuauccucagagaauaa

SEQ ID NO: 19795 - RNA, 19 nt, Artificial Sequence
  Synthetic oligonucleotide
uuuauccucagagaauaaa

SEQ ID NO: 19796 - RNA, 19 nt, Artificial Sequence
  Synthetic oligonucleotide
uuauccucagagaauaaau

SEQ ID NO: 19797 - RNA, 19 nt, Artificial Sequence
  Synthetic oligonucleotide
uauccucagagaauaaauu

SEQ ID NO: 19798 - RNA, 19 nt, Artificial Sequence
  Synthetic oligonucleotide
auccucagagaauaaauuc

SEQ ID NO: 19799 - RNA, 19 nt, Artificial Sequence
  Synthetic oligonucleotide
uccucagagaauaaauucc

SEQ ID NO: 19800 - RNA, 19 nt, Artificial Sequence
  Synthetic oligonucleotide
ccucagagaauaaauucca

SEQ ID NO: 19801 - RNA, 19 nt, Artificial Sequence
  Synthetic oligonucleotide
cucagagaauaaauuccaa

SEQ ID NO: 19802 - RNA, 19 nt, Artificial Sequence
  Synthetic oligonucleotide
ucagagaauaaauuccaaa

SEQ ID NO: 19803 - RNA, 19 nt, Artificial Sequence
  Synthetic oligonucleotide
cagagaauaaauuccaaaa

SEQ ID NO: 19804 - RNA, 19 nt, Artificial Sequence
  Synthetic oligonucleotide
agagaauaaauuccaaaac

SEQ ID NO: 19805 - RNA, 19 nt, Artificial Sequence
  Synthetic oligonucleotide
aaucuuaacaauacaacca

SEQ ID NO: 19806 - RNA, 19 nt, Artificial Sequence
  Synthetic oligonucleotide
aucuuaacaauacaaccaa

SEQ ID NO: 19807 - RNA, 19 nt, Artificial Sequence
  Synthetic oligonucleotide
ucuuaacaauacaaccaaa

SEQ ID NO: 19808 - RNA, 19 nt, Artificial Sequence
  Synthetic oligonucleotide
cuuaacaauacaaccaaaa

SEQ ID NO: 19809 - RNA, 19 nt, Artificial Sequence
  Synthetic oligonucleotide
uuaacaauacaaccaaaac

SEQ ID NO: 19810 - RNA, 19 nt, Artificial Sequence
  Synthetic oligonucleotide
uaacaauacaaccaaaaca

SEQ ID NO: 19811 - RNA, 19 nt, Artificial Sequence
  Synthetic oligonucleotide
aacaauacaaccaaaacaa

SEQ ID NO: 19812 - RNA, 19 nt, Artificial Sequence
  Synthetic oligonucleotide
guauuuggaaguuguauca

SEQ ID NO: 19813 - RNA, 19 nt, Artificial Sequence
  Synthetic oligonucleotide
uauuuggaaguuguaucaa

SEQ ID NO: 19814 - RNA, 19 nt, Artificial Sequence
  Synthetic oligonucleotide
uguaucaaagcauuuuuca

SEQ ID NO: 19815 - RNA, 19 nt, Artificial Sequence
  Synthetic oligonucleotide
guaucaaagcauuuuucaa

SEQ ID NO: 19816 - RNA, 19 nt, Artificial Sequence
  Synthetic oligonucleotide
uaucaaagcauuuuucaaa

SEQ ID NO: 19817 - RNA, 19 nt, Artificial Sequence
  Synthetic oligonucleotide
aucaaagcauuuuucaaaa

SEQ ID NO: 19818 - RNA, 19 nt, Artificial Sequence
  Synthetic oligonucleotide
ucaaagcauuuuucaaaau

SEQ ID NO: 19819 - RNA, 19 nt, Artificial Sequence
  Synthetic oligonucleotide
ugccaauaaccuaugacaa

SEQ ID NO: 19820 - RNA, 19 nt, Artificial Sequence
  Synthetic oligonucleotide
gccaauaaccuaugacaau

SEQ ID NO: 19821 - RNA, 19 nt, Artificial Sequence
  Synthetic oligonucleotide
caauaaccuaugacaaugg

SEQ ID NO: 19822 - RNA, 19 nt, Artificial Sequence
  Synthetic oligonucleotide
aauaaccuaugacaaugga

SEQ ID NO: 19823 - RNA, 19 nt, Artificial Sequence
  Synthetic oligonucleotide
auaaccuaugacaauggau

SEQ ID NO: 19824 - RNA, 19 nt, Artificial Sequence
  Synthetic oligonucleotide
uaaccuaugacaauggauu

SEQ ID NO: 19825 - RNA, 19 nt, Artificial Sequence
  Synthetic oligonucleotide
aaccuaugacaauggauuu

SEQ ID NO: 19826 - RNA, 19 nt, Artificial Sequence
  Synthetic oligonucleotide
ccuaugacaauggauuucu

SEQ ID NO: 19827 - RNA, 19 nt, Artificial Sequence
  Synthetic oligonucleotide
cuaugacaauggauuucuc

SEQ ID NO: 19828 - RNA, 19 nt, Artificial Sequence
  Synthetic oligonucleotide
uaugacaauggauuucucu

SEQ ID NO: 19829 - RNA, 19 nt, Artificial Sequence
  Synthetic oligonucleotide
acaauggauuucucuucau

SEQ ID NO: 19830 - RNA, 19 nt, Artificial Sequence
  Synthetic oligonucleotide
auggauuucucuucauuca

SEQ ID NO: 19831 - RNA, 19 nt, Artificial Sequence
  Synthetic oligonucleotide
ggauuucucuucauucaua

SEQ ID NO: 19832 - RNA, 19 nt, Artificial Sequence
  Synthetic oligonucleotide
gauuucucuucauucauac

SEQ ID NO: 19833 - RNA, 19 nt, Artificial Sequence
  Synthetic oligonucleotide
auuucucuucauucauaca

SEQ ID NO: 19834 - RNA, 19 nt, Artificial Sequence
  Synthetic oligonucleotide
uuucucuucauucauacag

SEQ ID NO: 19835 - RNA, 19 nt, Artificial Sequence
  Synthetic oligonucleotide
uucucuucauucauacaga

SEQ ID NO: 19836 - RNA, 19 nt, Artificial Sequence
  Synthetic oligonucleotide
ucucuucauucauacagac

SEQ ID NO: 19837 - RNA, 19 nt, Artificial Sequence
  Synthetic oligonucleotide
cucuucauucauacagaca

SEQ ID NO: 19838 - RNA, 19 nt, Artificial Sequence
  Synthetic oligonucleotide
ucuucauucauacagacaa

SEQ ID NO: 19839 - RNA, 19 nt, Artificial Sequence
  Synthetic oligonucleotide
cuucauucauacagacaaa

SEQ ID NO: 19840 - RNA, 19 nt, Artificial Sequence
  Synthetic oligonucleotide
uucauucauacagacaaac

SEQ ID NO: 19841 - RNA, 19 nt, Artificial Sequence
  Synthetic oligonucleotide
cauucauacagacaaaccu

SEQ ID NO: 19842 - RNA, 19 nt, Artificial Sequence
  Synthetic oligonucleotide
cauacagacaaaccuguuu

SEQ ID NO: 19843 - RNA, 19 nt, Artificial Sequence
  Synthetic oligonucleotide
auacagacaaaccuguuua

SEQ ID NO: 19844 - RNA, 19 nt, Artificial Sequence
  Synthetic oligonucleotide
uacagacaaaccuguuuau

SEQ ID NO: 19845 - RNA, 19 nt, Artificial Sequence
  Synthetic oligonucleotide
acagacaaaccuguuuaua

SEQ ID NO: 19846 - RNA, 19 nt, Artificial Sequence
  Synthetic oligonucleotide
cagacaaaccuguuuauac

SEQ ID NO: 19847 - RNA, 19 nt, Artificial Sequence
  Synthetic oligonucleotide
agacaaaccuguuuauacu

SEQ ID NO: 19848 - RNA, 19 nt, Artificial Sequence
  Synthetic oligonucleotide
gacaaaccuguuuauacuc

SEQ ID NO: 19849 - RNA, 19 nt, Artificial Sequence
  Synthetic oligonucleotide
acaaaccuguuuauacucc

SEQ ID NO: 19850 - RNA, 19 nt, Artificial Sequence
  Synthetic oligonucleotide
caaaccuguuuauacucca

SEQ ID NO: 19851 - RNA, 19 nt, Artificial Sequence
  Synthetic oligonucleotide
aaaccuguuuauacuccag

SEQ ID NO: 19852 - RNA, 19 nt, Artificial Sequence
  Synthetic oligonucleotide
aaccuguuuauacuccaga

SEQ ID NO: 19853 - RNA, 19 nt, Artificial Sequence
  Synthetic oligonucleotide
accuguuuauacuccagac

SEQ ID NO: 19854 - RNA, 19 nt, Artificial Sequence
  Synthetic oligonucleotide
aguuagaguuuauucguug

SEQ ID NO: 19855 - RNA, 19 nt, Artificial Sequence
  Synthetic oligonucleotide
guuagaguuuauucguuga

SEQ ID NO: 19856 - RNA, 19 nt, Artificial Sequence
  Synthetic oligonucleotide
uuagaguuuauucguugaa

SEQ ID NO: 19857 - RNA, 19 nt, Artificial Sequence
  Synthetic oligonucleotide
uagaguuuauucguugaau

SEQ ID NO: 19858 - RNA, 19 nt, Artificial Sequence
  Synthetic oligonucleotide
acgacuugaagccagccaa

SEQ ID NO: 19859 - RNA, 19 nt, Artificial Sequence
  Synthetic oligonucleotide
cgacuugaagccagccaaa

SEQ ID NO: 19860 - RNA, 19 nt, Artificial Sequence
  Synthetic oligonucleotide
gacuugaagccagccaaaa

SEQ ID NO: 19861 - RNA, 19 nt, Artificial Sequence
  Synthetic oligonucleotide
acuugaagccagccaaaag

SEQ ID NO: 19862 - RNA, 19 nt, Artificial Sequence
  Synthetic oligonucleotide
cuugaagccagccaaaaga

SEQ ID NO: 19863 - RNA, 19 nt, Artificial Sequence
  Synthetic oligonucleotide
uugaagccagccaaaagag

SEQ ID NO: 19864 - RNA, 19 nt, Artificial Sequence
  Synthetic oligonucleotide
ugaagccagccaaaagaga

SEQ ID NO: 19865 - RNA, 19 nt, Artificial Sequence
  Synthetic oligonucleotide
gaagccagccaaaagagaa

SEQ ID NO: 19866 - RNA, 19 nt, Artificial Sequence
  Synthetic oligonucleotide
aagccagccaaaagagaaa

SEQ ID NO: 19867 - RNA, 19 nt, Artificial Sequence
  Synthetic oligonucleotide
agccagccaaaagagaaac

SEQ ID NO: 19868 - RNA, 19 nt, Artificial Sequence
  Synthetic oligonucleotide
gccagccaaaagagaaacu

SEQ ID NO: 19869 - RNA, 19 nt, Artificial Sequence
  Synthetic oligonucleotide
ccagccaaaagagaaacug

SEQ ID NO: 19870 - RNA, 19 nt, Artificial Sequence
  Synthetic oligonucleotide
cagccaaaagagaaacugu

SEQ ID NO: 19871 - RNA, 19 nt, Artificial Sequence
  Synthetic oligonucleotide
agccaaaagagaaacuguc

SEQ ID NO: 19872 - RNA, 19 nt, Artificial Sequence
  Synthetic oligonucleotide
gccaaaagagaaacugucu

SEQ ID NO: 19873 - RNA, 19 nt, Artificial Sequence
  Synthetic oligonucleotide
ccaaaagagaaacugucuu

SEQ ID NO: 19874 - RNA, 19 nt, Artificial Sequence
  Synthetic oligonucleotide
caaaagagaaacugucuua

SEQ ID NO: 19875 - RNA, 19 nt, Artificial Sequence
  Synthetic oligonucleotide
aaaagagaaacugucuuaa

SEQ ID NO: 19876 - RNA, 19 nt, Artificial Sequence
  Synthetic oligonucleotide
aaagagaaacugucuuaac

SEQ ID NO: 19877 - RNA, 19 nt, Artificial Sequence
  Synthetic oligonucleotide
aagagaaacugucuuaacu

SEQ ID NO: 19878 - RNA, 19 nt, Artificial Sequence
  Synthetic oligonucleotide
gagaaacugucuuaacuuu

SEQ ID NO: 19879 - RNA, 19 nt, Artificial Sequence
  Synthetic oligonucleotide
agaaacugucuuaacuuuc

SEQ ID NO: 19880 - RNA, 19 nt, Artificial Sequence
  Synthetic oligonucleotide
gaaacugucuuaacuuuca

SEQ ID NO: 19881 - RNA, 19 nt, Artificial Sequence
  Synthetic oligonucleotide
acugucuuaacuuucauag

SEQ ID NO: 19882 - RNA, 19 nt, Artificial Sequence
  Synthetic oligonucleotide
cugucuuaacuuucauaga

SEQ ID NO: 19883 - RNA, 19 nt, Artificial Sequence
  Synthetic oligonucleotide
ugucuuaacuuucauagau

SEQ ID NO: 19884 - RNA, 19 nt, Artificial Sequence
  Synthetic oligonucleotide
gucuuaacuuucauagauc

SEQ ID NO: 19885 - RNA, 19 nt, Artificial Sequence
  Synthetic oligonucleotide
ucuuaacuuucauagaucc

SEQ ID NO: 19886 - RNA, 19 nt, Artificial Sequence
  Synthetic oligonucleotide
cuuaacuuucauagauccu

SEQ ID NO: 19887 - RNA, 19 nt, Artificial Sequence
  Synthetic oligonucleotide
uuaacuuucauagauccug

SEQ ID NO: 19888 - RNA, 19 nt, Artificial Sequence
  Synthetic oligonucleotide
uaacuuucauagauccuga

SEQ ID NO: 19889 - RNA, 19 nt, Artificial Sequence
  Synthetic oligonucleotide
aacuuucauagauccugaa

SEQ ID NO: 19890 - RNA, 19 nt, Artificial Sequence
  Synthetic oligonucleotide
acuuucauagauccugaag

SEQ ID NO: 19891 - RNA, 19 nt, Artificial Sequence
  Synthetic oligonucleotide
cuuucauagauccugaagg

SEQ ID NO: 19892 - RNA, 19 nt, Artificial Sequence
  Synthetic oligonucleotide
uuucauagauccugaagga

SEQ ID NO: 19893 - RNA, 19 nt, Artificial Sequence
  Synthetic oligonucleotide
uucauagauccugaaggau

SEQ ID NO: 19894 - RNA, 19 nt, Artificial Sequence
  Synthetic oligonucleotide
ucauagauccugaaggauc

SEQ ID NO: 19895 - RNA, 19 nt, Artificial Sequence
  Synthetic oligonucleotide
cauagauccugaaggauca

SEQ ID NO: 19896 - RNA, 19 nt, Artificial Sequence
  Synthetic oligonucleotide
auagauccugaaggaucag

SEQ ID NO: 19897 - RNA, 19 nt, Artificial Sequence
  Synthetic oligonucleotide
aguugacaugguagaagaa

SEQ ID NO: 19898 - RNA, 19 nt, Artificial Sequence
  Synthetic oligonucleotide
guugacaugguagaagaaa

SEQ ID NO: 19899 - RNA, 19 nt, Artificial Sequence
  Synthetic oligonucleotide
gacaugguagaagaaauug

SEQ ID NO: 19900 - RNA, 19 nt, Artificial Sequence
  Synthetic oligonucleotide
acaugguagaagaaauuga

SEQ ID NO: 19901 - RNA, 19 nt, Artificial Sequence
  Synthetic oligonucleotide
caugguagaagaaauugau

SEQ ID NO: 19902 - RNA, 19 nt, Artificial Sequence
  Synthetic oligonucleotide
gguagaagaaauugaucau

SEQ ID NO: 19903 - RNA, 19 nt, Artificial Sequence
  Synthetic oligonucleotide
guagaagaaauugaucaua

SEQ ID NO: 19904 - RNA, 19 nt, Artificial Sequence
  Synthetic oligonucleotide
uagaagaaauugaucauau

SEQ ID NO: 19905 - RNA, 19 nt, Artificial Sequence
  Synthetic oligonucleotide
aagaaauugaucauauugg

SEQ ID NO: 19906 - RNA, 19 nt, Artificial Sequence
  Synthetic oligonucleotide
agaaauugaucauauugga

SEQ ID NO: 19907 - RNA, 19 nt, Artificial Sequence
  Synthetic oligonucleotide
gaaauugaucauauuggaa

SEQ ID NO: 19908 - RNA, 19 nt, Artificial Sequence
  Synthetic oligonucleotide
aaauugaucauauuggaau

SEQ ID NO: 19909 - RNA, 19 nt, Artificial Sequence
  Synthetic oligonucleotide
aauugaucauauuggaauu

SEQ ID NO: 19910 - RNA, 19 nt, Artificial Sequence
  Synthetic oligonucleotide
auugaucauauuggaauua

SEQ ID NO: 19911 - RNA, 19 nt, Artificial Sequence
  Synthetic oligonucleotide
uugaucauauuggaauuau

SEQ ID NO: 19912 - RNA, 19 nt, Artificial Sequence
  Synthetic oligonucleotide
ugaucauauuggaauuauc

SEQ ID NO: 19913 - RNA, 19 nt, Artificial Sequence
  Synthetic oligonucleotide
gaucauauuggaauuaucu

SEQ ID NO: 19914 - RNA, 19 nt, Artificial Sequence
  Synthetic oligonucleotide
aucauauuggaauuaucuc

SEQ ID NO: 19915 - RNA, 19 nt, Artificial Sequence
  Synthetic oligonucleotide
ucauauuggaauuaucucu

SEQ ID NO: 19916 - RNA, 19 nt, Artificial Sequence
  Synthetic oligonucleotide
cauauuggaauuaucucuu

SEQ ID NO: 19917 - RNA, 19 nt, Artificial Sequence
  Synthetic oligonucleotide
auauuggaauuaucucuuu

SEQ ID NO: 19918 - RNA, 19 nt, Artificial Sequence
  Synthetic oligonucleotide
uauuggaauuaucucuuuu

SEQ ID NO: 19919 - RNA, 19 nt, Artificial Sequence
  Synthetic oligonucleotide
auuggaauuaucucuuuuc

SEQ ID NO: 19920 - RNA, 19 nt, Artificial Sequence
  Synthetic oligonucleotide
uuuccugacuucaagauuc

SEQ ID NO: 19921 - RNA, 19 nt, Artificial Sequence
  Synthetic oligonucleotide
uuccugacuucaagauucc

SEQ ID NO: 19922 - RNA, 19 nt, Artificial Sequence
  Synthetic oligonucleotide
uccugacuucaagauuccg

SEQ ID NO: 19923 - RNA, 19 nt, Artificial Sequence
  Synthetic oligonucleotide
ccugacuucaagauuccgu

SEQ ID NO: 19924 - RNA, 19 nt, Artificial Sequence
  Synthetic oligonucleotide
cugacuucaagauuccguc

SEQ ID NO: 19925 - RNA, 19 nt, Artificial Sequence
  Synthetic oligonucleotide
ugacuucaagauuccgucu

SEQ ID NO: 19926 - RNA, 19 nt, Artificial Sequence
  Synthetic oligonucleotide
gacuucaagauuccgucua

SEQ ID NO: 19927 - RNA, 19 nt, Artificial Sequence
  Synthetic oligonucleotide
acuucaagauuccgucuaa

SEQ ID NO: 19928 - RNA, 19 nt, Artificial Sequence
  Synthetic oligonucleotide
cuucaagauuccgucuaau

SEQ ID NO: 19929 - RNA, 19 nt, Artificial Sequence
  Synthetic oligonucleotide
uucaagauuccgucuaauc

SEQ ID NO: 19930 - RNA, 19 nt, Artificial Sequence
  Synthetic oligonucleotide
ucaagauuccgucuaaucc

SEQ ID NO: 19931 - RNA, 19 nt, Artificial Sequence
  Synthetic oligonucleotide
caagauuccgucuaauccu

SEQ ID NO: 19932 - RNA, 19 nt, Artificial Sequence
  Synthetic oligonucleotide
aagauuccgucuaauccua

SEQ ID NO: 19933 - RNA, 19 nt, Artificial Sequence
  Synthetic oligonucleotide
agauuccgucuaauccuag

SEQ ID NO: 19934 - RNA, 19 nt, Artificial Sequence
  Synthetic oligonucleotide
gauuccgucuaauccuaga

SEQ ID NO: 19935 - RNA, 19 nt, Artificial Sequence
  Synthetic oligonucleotide
auuccgucuaauccuagau

SEQ ID NO: 19936 - RNA, 19 nt, Artificial Sequence
  Synthetic oligonucleotide
uuccgucuaauccuagaua

SEQ ID NO: 19937 - RNA, 19 nt, Artificial Sequence
  Synthetic oligonucleotide
uccgucuaauccuagauau

SEQ ID NO: 19938 - RNA, 19 nt, Artificial Sequence
  Synthetic oligonucleotide
ccgucuaauccuagauaug

SEQ ID NO: 19939 - RNA, 19 nt, Artificial Sequence
  Synthetic oligonucleotide
cgucuaauccuagauaugg

SEQ ID NO: 19940 - RNA, 19 nt, Artificial Sequence
  Synthetic oligonucleotide
gucuaauccuagauauggu

SEQ ID NO: 19941 - RNA, 19 nt, Artificial Sequence
  Synthetic oligonucleotide
ucuaauccuagauauggua

SEQ ID NO: 19942 - RNA, 19 nt, Artificial Sequence
  Synthetic oligonucleotide
cuaauccuagauaugguau

SEQ ID NO: 19943 - RNA, 19 nt, Artificial Sequence
  Synthetic oligonucleotide
uaauccuagauaugguaug

SEQ ID NO: 19944 - RNA, 19 nt, Artificial Sequence
  Synthetic oligonucleotide
aauccuagauaugguaugu

SEQ ID NO: 19945 - RNA, 19 nt, Artificial Sequence
  Synthetic oligonucleotide
auccuagauaugguaugug

SEQ ID NO: 19946 - RNA, 19 nt, Artificial Sequence
  Synthetic oligonucleotide
caaggcuaaauauaaagag

SEQ ID NO: 19947 - RNA, 19 nt, Artificial Sequence
  Synthetic oligonucleotide
aaggcuaaauauaaagagg

SEQ ID NO: 19948 - RNA, 19 nt, Artificial Sequence
  Synthetic oligonucleotide
aggcuaaauauaaagagga

SEQ ID NO: 19949 - RNA, 19 nt, Artificial Sequence
  Synthetic oligonucleotide
ggcuaaauauaaagaggac

SEQ ID NO: 19950 - RNA, 19 nt, Artificial Sequence
  Synthetic oligonucleotide
gcuaaauauaaagaggacu

SEQ ID NO: 19951 - RNA, 19 nt, Artificial Sequence
  Synthetic oligonucleotide
cuaaauauaaagaggacuu

SEQ ID NO: 19952 - RNA, 19 nt, Artificial Sequence
  Synthetic oligonucleotide
uaaauauaaagaggacuuu

SEQ ID NO: 19953 - RNA, 19 nt, Artificial Sequence
  Synthetic oligonucleotide
aaauauaaagaggacuuuu

SEQ ID NO: 19954 - RNA, 19 nt, Artificial Sequence
  Synthetic oligonucleotide
aauauaaagaggacuuuuc

SEQ ID NO: 19955 - RNA, 19 nt, Artificial Sequence
  Synthetic oligonucleotide
auauaaagaggacuuuuca

SEQ ID NO: 19956 - RNA, 19 nt, Artificial Sequence
  Synthetic oligonucleotide
uauaaagaggacuuuucaa

SEQ ID NO: 19957 - RNA, 19 nt, Artificial Sequence
  Synthetic oligonucleotide
auaaagaggacuuuucaac

SEQ ID NO: 19958 - RNA, 19 nt, Artificial Sequence
  Synthetic oligonucleotide
uaaagaggacuuuucaaca

SEQ ID NO: 19959 - RNA, 19 nt, Artificial Sequence
  Synthetic oligonucleotide
aaagaggacuuuucaacaa

SEQ ID NO: 19960 - RNA, 19 nt, Artificial Sequence
  Synthetic oligonucleotide
aagaggacuuuucaacaac

SEQ ID NO: 19961 - RNA, 19 nt, Artificial Sequence
  Synthetic oligonucleotide
agaggacuuuucaacaacu

SEQ ID NO: 19962 - RNA, 19 nt, Artificial Sequence
  Synthetic oligonucleotide
gaggacuuuucaacaacug

SEQ ID NO: 19963 - RNA, 19 nt, Artificial Sequence
  Synthetic oligonucleotide
aggacuuuucaacaacugg

SEQ ID NO: 19964 - RNA, 19 nt, Artificial Sequence
  Synthetic oligonucleotide
ggacuuuucaacaacugga

SEQ ID NO: 19965 - RNA, 19 nt, Artificial Sequence
  Synthetic oligonucleotide
uauuuugaaguuaaagaau

SEQ ID NO: 19966 - RNA, 19 nt, Artificial Sequence
  Synthetic oligonucleotide
auuuugaaguuaaagaaua

SEQ ID NO: 19967 - RNA, 19 nt, Artificial Sequence
  Synthetic oligonucleotide
uuuugaaguuaaagaauau

SEQ ID NO: 19968 - RNA, 19 nt, Artificial Sequence
  Synthetic oligonucleotide
uuugaaguuaaagaauaug

SEQ ID NO: 19969 - RNA, 19 nt, Artificial Sequence
  Synthetic oligonucleotide
uugaaguuaaagaauaugu

SEQ ID NO: 19970 - RNA, 19 nt, Artificial Sequence
  Synthetic oligonucleotide
ugaaguuaaagaauauguc

SEQ ID NO: 19971 - RNA, 19 nt, Artificial Sequence
  Synthetic oligonucleotide
gaaguuaaagaauaugucu

SEQ ID NO: 19972 - RNA, 19 nt, Artificial Sequence
  Synthetic oligonucleotide
aaguuaaagaauaugucuu

SEQ ID NO: 19973 - RNA, 19 nt, Artificial Sequence
  Synthetic oligonucleotide
uaaagaauaugucuugcca

SEQ ID NO: 19974 - RNA, 19 nt, Artificial Sequence
  Synthetic oligonucleotide
aaagaauaugucuugccac

SEQ ID NO: 19975 - RNA, 19 nt, Artificial Sequence
  Synthetic oligonucleotide
aagaauaugucuugccaca

SEQ ID NO: 19976 - RNA, 19 nt, Artificial Sequence
  Synthetic oligonucleotide
agaauaugucuugccacau

SEQ ID NO: 19977 - RNA, 19 nt, Artificial Sequence
  Synthetic oligonucleotide
gaauaugucuugccacauu

SEQ ID NO: 19978 - RNA, 19 nt, Artificial Sequence
  Synthetic oligonucleotide
aauaugucuugccacauuu

SEQ ID NO: 19979 - RNA, 19 nt, Artificial Sequence
  Synthetic oligonucleotide
auaugucuugccacauuuu

SEQ ID NO: 19980 - RNA, 19 nt, Artificial Sequence
  Synthetic oligonucleotide
uaugucuugccacauuuuu

SEQ ID NO: 19981 - RNA, 19 nt, Artificial Sequence
  Synthetic oligonucleotide
augucuugccacauuuuuc

SEQ ID NO: 19982 - RNA, 19 nt, Artificial Sequence
  Synthetic oligonucleotide
ugucuugccacauuuuucu

SEQ ID NO: 19983 - RNA, 19 nt, Artificial Sequence
  Synthetic oligonucleotide
gucuugccacauuuuucug

SEQ ID NO: 19984 - RNA, 19 nt, Artificial Sequence
  Synthetic oligonucleotide
ucuugccacauuuuucugu

SEQ ID NO: 19985 - RNA, 19 nt, Artificial Sequence
  Synthetic oligonucleotide
cuugccacauuuuucuguc

SEQ ID NO: 19986 - RNA, 19 nt, Artificial Sequence
  Synthetic oligonucleotide
uugccacauuuuucugucu

SEQ ID NO: 19987 - RNA, 19 nt, Artificial Sequence
  Synthetic oligonucleotide
aagaacuuuaagaauuuug

SEQ ID NO: 19988 - RNA, 19 nt, Artificial Sequence
  Synthetic oligonucleotide
agaacuuuaagaauuuuga

SEQ ID NO: 19989 - RNA, 19 nt, Artificial Sequence
  Synthetic oligonucleotide
gaacuuuaagaauuuugaa

SEQ ID NO: 19990 - RNA, 19 nt, Artificial Sequence
  Synthetic oligonucleotide
acuuuaagaauuuugaaau

SEQ ID NO: 19991 - RNA, 19 nt, Artificial Sequence
  Synthetic oligonucleotide
cuuuaagaauuuugaaauu

SEQ ID NO: 19992 - RNA, 19 nt, Artificial Sequence
  Synthetic oligonucleotide
uuuaagaauuuugaaauua

SEQ ID NO: 19993 - RNA, 19 nt, Artificial Sequence
  Synthetic oligonucleotide
uuaagaauuuugaaauuac

SEQ ID NO: 19994 - RNA, 19 nt, Artificial Sequence
  Synthetic oligonucleotide
uaagaauuuugaaauuacu

SEQ ID NO: 19995 - RNA, 19 nt, Artificial Sequence
  Synthetic oligonucleotide
aauuuugaaauuacuauaa

SEQ ID NO: 19996 - RNA, 19 nt, Artificial Sequence
  Synthetic oligonucleotide
auuuugaaauuacuauaaa

SEQ ID NO: 19997 - RNA, 19 nt, Artificial Sequence
  Synthetic oligonucleotide
ugaaauuacuauaaaagca

SEQ ID NO: 19998 - RNA, 19 nt, Artificial Sequence
  Synthetic oligonucleotide
gaaauuacuauaaaagcaa

SEQ ID NO: 19999 - RNA, 19 nt, Artificial Sequence
  Synthetic oligonucleotide
aaauuacuauaaaagcaag

SEQ ID NO: 20000 - RNA, 19 nt, Artificial Sequence
  Synthetic oligonucleotide
aauuacuauaaaagcaaga

SEQ ID NO: 20001 - RNA, 19 nt, Artificial Sequence
  Synthetic oligonucleotide
auuacuauaaaagcaagau

SEQ ID NO: 20002 - RNA, 19 nt, Artificial Sequence
  Synthetic oligonucleotide
uuacuauaaaagcaagaua

SEQ ID NO: 20003 - RNA, 19 nt, Artificial Sequence
  Synthetic oligonucleotide
uacuauaaaagcaagauau

SEQ ID NO: 20004 - RNA, 19 nt, Artificial Sequence
  Synthetic oligonucleotide
acuauaaaagcaagauauu

SEQ ID NO: 20005 - RNA, 19 nt, Artificial Sequence
  Synthetic oligonucleotide
cuauaaaagcaagauauuu

SEQ ID NO: 20006 - RNA, 19 nt, Artificial Sequence
  Synthetic oligonucleotide
uauaaaagcaagauauuuu

SEQ ID NO: 20007 - RNA, 19 nt, Artificial Sequence
  Synthetic oligonucleotide
auaaaagcaagauauuuuu

SEQ ID NO: 20008 - RNA, 19 nt, Artificial Sequence
  Synthetic oligonucleotide
agauauuuuuauaauaaag

SEQ ID NO: 20009 - RNA, 19 nt, Artificial Sequence
  Synthetic oligonucleotide
gauauuuuuauaauaaagu

SEQ ID NO: 20010 - RNA, 19 nt, Artificial Sequence
  Synthetic oligonucleotide
auauuuuuauaauaaagua

SEQ ID NO: 20011 - RNA, 19 nt, Artificial Sequence
  Synthetic oligonucleotide
uauuuuuauaauaaaguag

SEQ ID NO: 20012 - RNA, 19 nt, Artificial Sequence
  Synthetic oligonucleotide
auuuuuauaauaaaguagu

SEQ ID NO: 20013 - RNA, 19 nt, Artificial Sequence
  Synthetic oligonucleotide
uuuuuauaauaaaguaguc

SEQ ID NO: 20014 - RNA, 19 nt, Artificial Sequence
  Synthetic oligonucleotide
uuuuauaauaaaguaguca

SEQ ID NO: 20015 - RNA, 19 nt, Artificial Sequence
  Synthetic oligonucleotide
uuuauaauaaaguagucac

SEQ ID NO: 20016 - RNA, 19 nt, Artificial Sequence
  Synthetic oligonucleotide
uuauaauaaaguagucacu

SEQ ID NO: 20017 - RNA, 19 nt, Artificial Sequence
  Synthetic oligonucleotide
uauaauaaaguagucacug

SEQ ID NO: 20018 - RNA, 19 nt, Artificial Sequence
  Synthetic oligonucleotide
auaauaaaguagucacuga

SEQ ID NO: 20019 - RNA, 19 nt, Artificial Sequence
  Synthetic oligonucleotide
uaauaaaguagucacugag

SEQ ID NO: 20020 - RNA, 19 nt, Artificial Sequence
  Synthetic oligonucleotide
aauaaaguagucacugagg

SEQ ID NO: 20021 - RNA, 19 nt, Artificial Sequence
  Synthetic oligonucleotide
auaaaguagucacugaggc

SEQ ID NO: 20022 - RNA, 19 nt, Artificial Sequence
  Synthetic oligonucleotide
uaaaguagucacugaggcu

SEQ ID NO: 20023 - RNA, 19 nt, Artificial Sequence
  Synthetic oligonucleotide
acguuuauaucacauuugg

SEQ ID NO: 20024 - RNA, 19 nt, Artificial Sequence
  Synthetic oligonucleotide
cguuuauaucacauuugga

SEQ ID NO: 20025 - RNA, 19 nt, Artificial Sequence
  Synthetic oligonucleotide
guuuauaucacauuuggaa

SEQ ID NO: 20026 - RNA, 19 nt, Artificial Sequence
  Synthetic oligonucleotide
uuuauaucacauuuggaau

SEQ ID NO: 20027 - RNA, 19 nt, Artificial Sequence
  Synthetic oligonucleotide
uuauaucacauuuggaaua

SEQ ID NO: 20028 - RNA, 19 nt, Artificial Sequence
  Synthetic oligonucleotide
uauaucacauuuggaauaa

SEQ ID NO: 20029 - RNA, 19 nt, Artificial Sequence
  Synthetic oligonucleotide
auaucacauuuggaauaag

SEQ ID NO: 20030 - RNA, 19 nt, Artificial Sequence
  Synthetic oligonucleotide
uaucacauuuggaauaaga

SEQ ID NO: 20031 - RNA, 19 nt, Artificial Sequence
  Synthetic oligonucleotide
aucacauuuggaauaagag

SEQ ID NO: 20032 - RNA, 19 nt, Artificial Sequence
  Synthetic oligonucleotide
ucacauuuggaauaagaga

SEQ ID NO: 20033 - RNA, 19 nt, Artificial Sequence
  Synthetic oligonucleotide
cacauuuggaauaagagaa

SEQ ID NO: 20034 - RNA, 19 nt, Artificial Sequence
  Synthetic oligonucleotide
acauuuggaauaagagaag

SEQ ID NO: 20035 - RNA, 19 nt, Artificial Sequence
  Synthetic oligonucleotide
cauuuggaauaagagaaga

SEQ ID NO: 20036 - RNA, 19 nt, Artificial Sequence
  Synthetic oligonucleotide
auuuggaauaagagaagac

SEQ ID NO: 20037 - RNA, 19 nt, Artificial Sequence
  Synthetic oligonucleotide
uuuggaauaagagaagacu

SEQ ID NO: 20038 - RNA, 19 nt, Artificial Sequence
  Synthetic oligonucleotide
uuggaauaagagaagacuu

SEQ ID NO: 20039 - RNA, 19 nt, Artificial Sequence
  Synthetic oligonucleotide
uggaauaagagaagacuua

SEQ ID NO: 20040 - RNA, 19 nt, Artificial Sequence
  Synthetic oligonucleotide
ggaauaagagaagacuuaa

SEQ ID NO: 20041 - RNA, 19 nt, Artificial Sequence
  Synthetic oligonucleotide
gaauaagagaagacuuaaa

SEQ ID NO: 20042 - RNA, 19 nt, Artificial Sequence
  Synthetic oligonucleotide
aauaagagaagacuuaaaa

SEQ ID NO: 20043 - RNA, 19 nt, Artificial Sequence
  Synthetic oligonucleotide
auaagagaagacuuaaaag

SEQ ID NO: 20044 - RNA, 19 nt, Artificial Sequence
  Synthetic oligonucleotide
uaagagaagacuuaaaaga

SEQ ID NO: 20045 - RNA, 19 nt, Artificial Sequence
  Synthetic oligonucleotide
aagagaagacuuaaaagau

SEQ ID NO: 20046 - RNA, 19 nt, Artificial Sequence
  Synthetic oligonucleotide
agagaagacuuaaaagaug

SEQ ID NO: 20047 - RNA, 19 nt, Artificial Sequence
  Synthetic oligonucleotide
gagaagacuuaaaagauga

SEQ ID NO: 20048 - RNA, 19 nt, Artificial Sequence
  Synthetic oligonucleotide
agaagacuuaaaagaugau

SEQ ID NO: 20049 - RNA, 19 nt, Artificial Sequence
  Synthetic oligonucleotide
gaagacuuaaaagaugauc

SEQ ID NO: 20050 - RNA, 19 nt, Artificial Sequence
  Synthetic oligonucleotide
aagacuuaaaagaugauca

SEQ ID NO: 20051 - RNA, 19 nt, Artificial Sequence
  Synthetic oligonucleotide
agacuuaaaagaugaucaa

SEQ ID NO: 20052 - RNA, 19 nt, Artificial Sequence
  Synthetic oligonucleotide
gacuuaaaagaugaucaaa

SEQ ID NO: 20053 - RNA, 19 nt, Artificial Sequence
  Synthetic oligonucleotide
acuuaaaagaugaucaaaa

SEQ ID NO: 20054 - RNA, 19 nt, Artificial Sequence
  Synthetic oligonucleotide
cuuaaaagaugaucaaaaa

SEQ ID NO: 20055 - RNA, 19 nt, Artificial Sequence
  Synthetic oligonucleotide
uuaaaagaugaucaaaaag

SEQ ID NO: 20056 - RNA, 19 nt, Artificial Sequence
  Synthetic oligonucleotide
uaaaagaugaucaaaaaga

SEQ ID NO: 20057 - RNA, 19 nt, Artificial Sequence
  Synthetic oligonucleotide
aaaagaugaucaaaaagaa

SEQ ID NO: 20058 - RNA, 19 nt, Artificial Sequence
  Synthetic oligonucleotide
aaagaugaucaaaaagaaa

SEQ ID NO: 20059 - RNA, 19 nt, Artificial Sequence
  Synthetic oligonucleotide
aagaugaucaaaaagaaau

SEQ ID NO: 20060 - RNA, 19 nt, Artificial Sequence
  Synthetic oligonucleotide
agaugaucaaaaagaaaug

SEQ ID NO: 20061 - RNA, 19 nt, Artificial Sequence
  Synthetic oligonucleotide
gaugaucaaaaagaaauga

SEQ ID NO: 20062 - RNA, 19 nt, Artificial Sequence
  Synthetic oligonucleotide
augaucaaaaagaaaugau

SEQ ID NO: 20063 - RNA, 19 nt, Artificial Sequence
  Synthetic oligonucleotide
ugaucaaaaagaaaugaug

SEQ ID NO: 20064 - RNA, 19 nt, Artificial Sequence
  Synthetic oligonucleotide
gaucaaaaagaaaugaugc

SEQ ID NO: 20065 - RNA, 19 nt, Artificial Sequence
  Synthetic oligonucleotide
aucaaaaagaaaugaugca

SEQ ID NO: 20066 - RNA, 19 nt, Artificial Sequence
  Synthetic oligonucleotide
ucaaaaagaaaugaugcaa

SEQ ID NO: 20067 - RNA, 19 nt, Artificial Sequence
  Synthetic oligonucleotide
caaaaagaaaugaugcaaa

SEQ ID NO: 20068 - RNA, 19 nt, Artificial Sequence
  Synthetic oligonucleotide
aaaaagaaaugaugcaaac

SEQ ID NO: 20069 - RNA, 19 nt, Artificial Sequence
  Synthetic oligonucleotide
aaaagaaaugaugcaaaca

SEQ ID NO: 20070 - RNA, 19 nt, Artificial Sequence
  Synthetic oligonucleotide
aaagaaaugaugcaaacag

SEQ ID NO: 20071 - RNA, 19 nt, Artificial Sequence
  Synthetic oligonucleotide
aagaaaugaugcaaacagc

SEQ ID NO: 20072 - RNA, 19 nt, Artificial Sequence
  Synthetic oligonucleotide
agaaaugaugcaaacagca

SEQ ID NO: 20073 - RNA, 19 nt, Artificial Sequence
  Synthetic oligonucleotide
gaaaugaugcaaacagcaa

SEQ ID NO: 20074 - RNA, 19 nt, Artificial Sequence
  Synthetic oligonucleotide
aaaugaugcaaacagcaau

SEQ ID NO: 20075 - RNA, 19 nt, Artificial Sequence
  Synthetic oligonucleotide
aaugaugcaaacagcaaug

SEQ ID NO: 20076 - RNA, 19 nt, Artificial Sequence
  Synthetic oligonucleotide
caauguugauaaauggaau

SEQ ID NO: 20077 - RNA, 19 nt, Artificial Sequence
  Synthetic oligonucleotide
guugauaaauggaauugcu

SEQ ID NO: 20078 - RNA, 19 nt, Artificial Sequence
  Synthetic oligonucleotide
uugauaaauggaauugcuc

SEQ ID NO: 20079 - RNA, 19 nt, Artificial Sequence
  Synthetic oligonucleotide
gauaaauggaauugcucaa

SEQ ID NO: 20080 - RNA, 19 nt, Artificial Sequence
  Synthetic oligonucleotide
auaaauggaauugcucaag

SEQ ID NO: 20081 - RNA, 19 nt, Artificial Sequence
  Synthetic oligonucleotide
uaaauggaauugcucaagu

SEQ ID NO: 20082 - RNA, 19 nt, Artificial Sequence
  Synthetic oligonucleotide
aauggaauugcucaaguca

SEQ ID NO: 20083 - RNA, 19 nt, Artificial Sequence
  Synthetic oligonucleotide
auggaauugcucaagucac

SEQ ID NO: 20084 - RNA, 19 nt, Artificial Sequence
  Synthetic oligonucleotide
uggaauugcucaagucaca

SEQ ID NO: 20085 - RNA, 19 nt, Artificial Sequence
  Synthetic oligonucleotide
ggaauugcucaagucacau

SEQ ID NO: 20086 - RNA, 19 nt, Artificial Sequence
  Synthetic oligonucleotide
gaauugcucaagucacauu

SEQ ID NO: 20087 - RNA, 19 nt, Artificial Sequence
  Synthetic oligonucleotide
aauugcucaagucacauuu

SEQ ID NO: 20088 - RNA, 19 nt, Artificial Sequence
  Synthetic oligonucleotide
auugcucaagucacauuug

SEQ ID NO: 20089 - RNA, 19 nt, Artificial Sequence
  Synthetic oligonucleotide
uugcucaagucacauuuga

SEQ ID NO: 20090 - RNA, 19 nt, Artificial Sequence
  Synthetic oligonucleotide
gcucaagucacauuugauu

SEQ ID NO: 20091 - RNA, 19 nt, Artificial Sequence
  Synthetic oligonucleotide
aagucacauuugauucuga

SEQ ID NO: 20092 - RNA, 19 nt, Artificial Sequence
  Synthetic oligonucleotide
agucacauuugauucugaa

SEQ ID NO: 20093 - RNA, 19 nt, Artificial Sequence
  Synthetic oligonucleotide
gucacauuugauucugaaa

SEQ ID NO: 20094 - RNA, 19 nt, Artificial Sequence
  Synthetic oligonucleotide
ucacauuugauucugaaac

SEQ ID NO: 20095 - RNA, 19 nt, Artificial Sequence
  Synthetic oligonucleotide
acauuugauucugaaacag

SEQ ID NO: 20096 - RNA, 19 nt, Artificial Sequence
  Synthetic oligonucleotide
uuugauucugaaacagcag

SEQ ID NO: 20097 - RNA, 19 nt, Artificial Sequence
  Synthetic oligonucleotide
uugauucugaaacagcagu

SEQ ID NO: 20098 - RNA, 19 nt, Artificial Sequence
  Synthetic oligonucleotide
ugauucugaaacagcaguc

SEQ ID NO: 20099 - RNA, 19 nt, Artificial Sequence
  Synthetic oligonucleotide
gauucugaaacagcaguca

SEQ ID NO: 20100 - RNA, 19 nt, Artificial Sequence
  Synthetic oligonucleotide
auucugaaacagcagucaa

SEQ ID NO: 20101 - RNA, 19 nt, Artificial Sequence
  Synthetic oligonucleotide
uucugaaacagcagucaaa

SEQ ID NO: 20102 - RNA, 19 nt, Artificial Sequence
  Synthetic oligonucleotide
ucugaaacagcagucaaag

SEQ ID NO: 20103 - RNA, 19 nt, Artificial Sequence
  Synthetic oligonucleotide
cugaaacagcagucaaaga

SEQ ID NO: 20104 - RNA, 19 nt, Artificial Sequence
  Synthetic oligonucleotide
ugaaacagcagucaaagaa

SEQ ID NO: 20105 - RNA, 19 nt, Artificial Sequence
  Synthetic oligonucleotide
gaaacagcagucaaagaac

SEQ ID NO: 20106 - RNA, 19 nt, Artificial Sequence
  Synthetic oligonucleotide
aaacagcagucaaagaacu

SEQ ID NO: 20107 - RNA, 19 nt, Artificial Sequence
  Synthetic oligonucleotide
acagcagucaaagaacugu

SEQ ID NO: 20108 - RNA, 19 nt, Artificial Sequence
  Synthetic oligonucleotide
agcagucaaagaacuguca

SEQ ID NO: 20109 - RNA, 19 nt, Artificial Sequence
  Synthetic oligonucleotide
gcagucaaagaacugucau

SEQ ID NO: 20110 - RNA, 19 nt, Artificial Sequence
  Synthetic oligonucleotide
agucaaagaacugucauac

SEQ ID NO: 20111 - RNA, 19 nt, Artificial Sequence
  Synthetic oligonucleotide
gucaaagaacugucauacu

SEQ ID NO: 20112 - RNA, 19 nt, Artificial Sequence
  Synthetic oligonucleotide
ucaaagaacugucauacua

SEQ ID NO: 20113 - RNA, 19 nt, Artificial Sequence
  Synthetic oligonucleotide
aagaacugucauacuacag

SEQ ID NO: 20114 - RNA, 19 nt, Artificial Sequence
  Synthetic oligonucleotide
gaacugucauacuacaguu

SEQ ID NO: 20115 - RNA, 19 nt, Artificial Sequence
  Synthetic oligonucleotide
aacugucauacuacaguuu

SEQ ID NO: 20116 - RNA, 19 nt, Artificial Sequence
  Synthetic oligonucleotide
acugucauacuacaguuua

SEQ ID NO: 20117 - RNA, 19 nt, Artificial Sequence
  Synthetic oligonucleotide
cugucauacuacaguuuag

SEQ ID NO: 20118 - RNA, 19 nt, Artificial Sequence
  Synthetic oligonucleotide
ugucauacuacaguuuaga

SEQ ID NO: 20119 - RNA, 19 nt, Artificial Sequence
  Synthetic oligonucleotide
gucauacuacaguuuagaa

SEQ ID NO: 20120 - RNA, 19 nt, Artificial Sequence
  Synthetic oligonucleotide
ucauacuacaguuuagaag

SEQ ID NO: 20121 - RNA, 19 nt, Artificial Sequence
  Synthetic oligonucleotide
cauacuacaguuuagaaga

SEQ ID NO: 20122 - RNA, 19 nt, Artificial Sequence
  Synthetic oligonucleotide
auacuacaguuuagaagau

SEQ ID NO: 20123 - RNA, 19 nt, Artificial Sequence
  Synthetic oligonucleotide
uacuacaguuuagaagauu

SEQ ID NO: 20124 - RNA, 19 nt, Artificial Sequence
  Synthetic oligonucleotide
acuacaguuuagaagauuu

SEQ ID NO: 20125 - RNA, 19 nt, Artificial Sequence
  Synthetic oligonucleotide
cuacaguuuagaagauuua

SEQ ID NO: 20126 - RNA, 19 nt, Artificial Sequence
  Synthetic oligonucleotide
uacaguuuagaagauuuaa

SEQ ID NO: 20127 - RNA, 19 nt, Artificial Sequence
  Synthetic oligonucleotide
acaguuuagaagauuuaaa

SEQ ID NO: 20128 - RNA, 19 nt, Artificial Sequence
  Synthetic oligonucleotide
caguuuagaagauuuaaac

SEQ ID NO: 20129 - RNA, 19 nt, Artificial Sequence
  Synthetic oligonucleotide
aguuuagaagauuuaaaca

SEQ ID NO: 20130 - RNA, 19 nt, Artificial Sequence
  Synthetic oligonucleotide
guuuagaagauuuaaacaa

SEQ ID NO: 20131 - RNA, 19 nt, Artificial Sequence
  Synthetic oligonucleotide
uuuagaagauuuaaacaac

SEQ ID NO: 20132 - RNA, 19 nt, Artificial Sequence
  Synthetic oligonucleotide
uuagaagauuuaaacaaca

SEQ ID NO: 20133 - RNA, 19 nt, Artificial Sequence
  Synthetic oligonucleotide
uagaagauuuaaacaacaa

SEQ ID NO: 20134 - RNA, 19 nt, Artificial Sequence
  Synthetic oligonucleotide
agaagauuuaaacaacaag

SEQ ID NO: 20135 - RNA, 19 nt, Artificial Sequence
  Synthetic oligonucleotide
gaagauuuaaacaacaagu

SEQ ID NO: 20136 - RNA, 19 nt, Artificial Sequence
  Synthetic oligonucleotide
aagauuuaaacaacaagua

SEQ ID NO: 20137 - RNA, 19 nt, Artificial Sequence
  Synthetic oligonucleotide
agauuuaaacaacaaguac

SEQ ID NO: 20138 - RNA, 19 nt, Artificial Sequence
  Synthetic oligonucleotide
gauuuaaacaacaaguacc

SEQ ID NO: 20139 - RNA, 19 nt, Artificial Sequence
  Synthetic oligonucleotide
aguaccuuuauauugcugu

SEQ ID NO: 20140 - RNA, 19 nt, Artificial Sequence
  Synthetic oligonucleotide
uaccuuuauauugcuguaa

SEQ ID NO: 20141 - RNA, 19 nt, Artificial Sequence
  Synthetic oligonucleotide
accuuuauauugcuguaac

SEQ ID NO: 20142 - RNA, 19 nt, Artificial Sequence
  Synthetic oligonucleotide
ccuuuauauugcuguaaca

SEQ ID NO: 20143 - RNA, 19 nt, Artificial Sequence
  Synthetic oligonucleotide
cuuuauauugcuguaacag

SEQ ID NO: 20144 - RNA, 19 nt, Artificial Sequence
  Synthetic oligonucleotide
uuuauauugcuguaacagu

SEQ ID NO: 20145 - RNA, 19 nt, Artificial Sequence
  Synthetic oligonucleotide
uuauauugcuguaacaguc

SEQ ID NO: 20146 - RNA, 19 nt, Artificial Sequence
  Synthetic oligonucleotide
uauauugcuguaacaguca

SEQ ID NO: 20147 - RNA, 19 nt, Artificial Sequence
  Synthetic oligonucleotide
auauugcuguaacagucau

SEQ ID NO: 20148 - RNA, 19 nt, Artificial Sequence
  Synthetic oligonucleotide
uauugcuguaacagucaua

SEQ ID NO: 20149 - RNA, 19 nt, Artificial Sequence
  Synthetic oligonucleotide
auugcuguaacagucauag

SEQ ID NO: 20150 - RNA, 19 nt, Artificial Sequence
  Synthetic oligonucleotide
uugcuguaacagucauaga

SEQ ID NO: 20151 - RNA, 19 nt, Artificial Sequence
  Synthetic oligonucleotide
ugcuguaacagucauagag

SEQ ID NO: 20152 - RNA, 19 nt, Artificial Sequence
  Synthetic oligonucleotide
gcuguaacagucauagagu

SEQ ID NO: 20153 - RNA, 19 nt, Artificial Sequence
  Synthetic oligonucleotide
cuguaacagucauagaguc

SEQ ID NO: 20154 - RNA, 19 nt, Artificial Sequence
  Synthetic oligonucleotide
uguaacagucauagagucu

SEQ ID NO: 20155 - RNA, 19 nt, Artificial Sequence
  Synthetic oligonucleotide
guaacagucauagagucua

SEQ ID NO: 20156 - RNA, 19 nt, Artificial Sequence
  Synthetic oligonucleotide
uaacagucauagagucuac

SEQ ID NO: 20157 - RNA, 19 nt, Artificial Sequence
  Synthetic oligonucleotide
aacagucauagagucuaca

SEQ ID NO: 20158 - RNA, 19 nt, Artificial Sequence
  Synthetic oligonucleotide
acagucauagagucuacag

SEQ ID NO: 20159 - RNA, 19 nt, Artificial Sequence
  Synthetic oligonucleotide
cagucauagagucuacagg

SEQ ID NO: 20160 - RNA, 19 nt, Artificial Sequence
  Synthetic oligonucleotide
agucauagagucuacaggu

SEQ ID NO: 20161 - RNA, 19 nt, Artificial Sequence
  Synthetic oligonucleotide
gucauagagucuacaggug

SEQ ID NO: 20162 - RNA, 19 nt, Artificial Sequence
  Synthetic oligonucleotide
ucauagagucuacaggugg

SEQ ID NO: 20163 - RNA, 19 nt, Artificial Sequence
  Synthetic oligonucleotide
cauagagucuacaggugga

SEQ ID NO: 20164 - RNA, 19 nt, Artificial Sequence
  Synthetic oligonucleotide
auagagucuacagguggau

SEQ ID NO: 20165 - RNA, 19 nt, Artificial Sequence
  Synthetic oligonucleotide
uagagucuacagguggauu

SEQ ID NO: 20166 - RNA, 19 nt, Artificial Sequence
  Synthetic oligonucleotide
agagucuacagguggauuu

SEQ ID NO: 20167 - RNA, 19 nt, Artificial Sequence
  Synthetic oligonucleotide
gagucuacagguggauuuu

SEQ ID NO: 20168 - RNA, 19 nt, Artificial Sequence
  Synthetic oligonucleotide
agucuacagguggauuuuc

SEQ ID NO: 20169 - RNA, 19 nt, Artificial Sequence
  Synthetic oligonucleotide
gucuacagguggauuuucu

SEQ ID NO: 20170 - RNA, 19 nt, Artificial Sequence
  Synthetic oligonucleotide
ucuacagguggauuuucug

SEQ ID NO: 20171 - RNA, 19 nt, Artificial Sequence
  Synthetic oligonucleotide
cuacagguggauuuucuga

SEQ ID NO: 20172 - RNA, 19 nt, Artificial Sequence
  Synthetic oligonucleotide
uacagguggauuuucugaa

SEQ ID NO: 20173 - RNA, 19 nt, Artificial Sequence
  Synthetic oligonucleotide
acagguggauuuucugaag

SEQ ID NO: 20174 - RNA, 19 nt, Artificial Sequence
  Synthetic oligonucleotide
cagguggauuuucugaaga

SEQ ID NO: 20175 - RNA, 19 nt, Artificial Sequence
  Synthetic oligonucleotide
agguggauuuucugaagag

SEQ ID NO: 20176 - RNA, 19 nt, Artificial Sequence
  Synthetic oligonucleotide
gguggauuuucugaagagg

SEQ ID NO: 20177 - RNA, 19 nt, Artificial Sequence
  Synthetic oligonucleotide
guggauuuucugaagaggc

SEQ ID NO: 20178 - RNA, 19 nt, Artificial Sequence
  Synthetic oligonucleotide
uggauuuucugaagaggca

SEQ ID NO: 20179 - RNA, 19 nt, Artificial Sequence
  Synthetic oligonucleotide
ggauuuucugaagaggcag

SEQ ID NO: 20180 - RNA, 19 nt, Artificial Sequence
  Synthetic oligonucleotide
gauuuucugaagaggcaga

SEQ ID NO: 20181 - RNA, 19 nt, Artificial Sequence
  Synthetic oligonucleotide
auuuucugaagaggcagaa

SEQ ID NO: 20182 - RNA, 19 nt, Artificial Sequence
  Synthetic oligonucleotide
uuuucugaagaggcagaaa

SEQ ID NO: 20183 - RNA, 19 nt, Artificial Sequence
  Synthetic oligonucleotide
uuucugaagaggcagaaau

SEQ ID NO: 20184 - RNA, 19 nt, Artificial Sequence
  Synthetic oligonucleotide
uucugaagaggcagaaaua

SEQ ID NO: 20185 - RNA, 19 nt, Artificial Sequence
  Synthetic oligonucleotide
ucugaagaggcagaaauac

SEQ ID NO: 20186 - RNA, 19 nt, Artificial Sequence
  Synthetic oligonucleotide
cugaagaggcagaaauacc

SEQ ID NO: 20187 - RNA, 19 nt, Artificial Sequence
  Synthetic oligonucleotide
ugaagaggcagaaauaccu

SEQ ID NO: 20188 - RNA, 19 nt, Artificial Sequence
  Synthetic oligonucleotide
gaagaggcagaaauaccug

SEQ ID NO: 20189 - RNA, 19 nt, Artificial Sequence
  Synthetic oligonucleotide
aagaggcagaaauaccugg

SEQ ID NO: 20190 - RNA, 19 nt, Artificial Sequence
  Synthetic oligonucleotide
agaggcagaaauaccuggc

SEQ ID NO: 20191 - RNA, 19 nt, Artificial Sequence
  Synthetic oligonucleotide
gaggcagaaauaccuggca

SEQ ID NO: 20192 - RNA, 19 nt, Artificial Sequence
  Synthetic oligonucleotide
aggcagaaauaccuggcau

SEQ ID NO: 20193 - RNA, 19 nt, Artificial Sequence
  Synthetic oligonucleotide
ggcagaaauaccuggcauc

SEQ ID NO: 20194 - RNA, 19 nt, Artificial Sequence
  Synthetic oligonucleotide
gcagaaauaccuggcauca

SEQ ID NO: 20195 - RNA, 19 nt, Artificial Sequence
  Synthetic oligonucleotide
cagaaauaccuggcaucaa

SEQ ID NO: 20196 - RNA, 19 nt, Artificial Sequence
  Synthetic oligonucleotide
agaaauaccuggcaucaaa

SEQ ID NO: 20197 - RNA, 19 nt, Artificial Sequence
  Synthetic oligonucleotide
gaaauaccuggcaucaaau

SEQ ID NO: 20198 - RNA, 19 nt, Artificial Sequence
  Synthetic oligonucleotide
aaauaccuggcaucaaaua

SEQ ID NO: 20199 - RNA, 19 nt, Artificial Sequence
  Synthetic oligonucleotide
aauaccuggcaucaaauau

SEQ ID NO: 20200 - RNA, 19 nt, Artificial Sequence
  Synthetic oligonucleotide
auaccuggcaucaaauaug

SEQ ID NO: 20201 - RNA, 19 nt, Artificial Sequence
  Synthetic oligonucleotide
uaccuggcaucaaauaugu

SEQ ID NO: 20202 - RNA, 19 nt, Artificial Sequence
  Synthetic oligonucleotide
accuggcaucaaauauguc

SEQ ID NO: 20203 - RNA, 19 nt, Artificial Sequence
  Synthetic oligonucleotide
ccuggcaucaaauaugucc

SEQ ID NO: 20204 - RNA, 19 nt, Artificial Sequence
  Synthetic oligonucleotide
cuggcaucaaauauguccu

SEQ ID NO: 20205 - RNA, 19 nt, Artificial Sequence
  Synthetic oligonucleotide
uggcaucaaauauguccuc

SEQ ID NO: 20206 - RNA, 19 nt, Artificial Sequence
  Synthetic oligonucleotide
ggcaucaaauauguccucu

SEQ ID NO: 20207 - RNA, 19 nt, Artificial Sequence
  Synthetic oligonucleotide
gcaucaaauauguccucuc

SEQ ID NO: 20208 - RNA, 19 nt, Artificial Sequence
  Synthetic oligonucleotide
aucaaauauguccucucuc

SEQ ID NO: 20209 - RNA, 19 nt, Artificial Sequence
  Synthetic oligonucleotide
ucaaauauguccucucucc

SEQ ID NO: 20210 - RNA, 19 nt, Artificial Sequence
  Synthetic oligonucleotide
caaauauguccucucuccc

SEQ ID NO: 20211 - RNA, 19 nt, Artificial Sequence
  Synthetic oligonucleotide
aaauauguccucucucccu

SEQ ID NO: 20212 - RNA, 19 nt, Artificial Sequence
  Synthetic oligonucleotide
aauauguccucucucccua

SEQ ID NO: 20213 - RNA, 19 nt, Artificial Sequence
  Synthetic oligonucleotide
auauguccucucucccuac

SEQ ID NO: 20214 - RNA, 19 nt, Artificial Sequence
  Synthetic oligonucleotide
uauguccucucucccuaca

SEQ ID NO: 20215 - RNA, 19 nt, Artificial Sequence
  Synthetic oligonucleotide
auguccucucucccuacaa

SEQ ID NO: 20216 - RNA, 19 nt, Artificial Sequence
  Synthetic oligonucleotide
uguccucucucccuacaaa

SEQ ID NO: 20217 - RNA, 19 nt, Artificial Sequence
  Synthetic oligonucleotide
guccucucucccuacaaac

SEQ ID NO: 20218 - RNA, 19 nt, Artificial Sequence
  Synthetic oligonucleotide
uccucucucccuacaaacu

SEQ ID NO: 20219 - RNA, 19 nt, Artificial Sequence
  Synthetic oligonucleotide
ccucucucccuacaaacug

SEQ ID NO: 20220 - RNA, 19 nt, Artificial Sequence
  Synthetic oligonucleotide
cucucucccuacaaacuga

SEQ ID NO: 20221 - RNA, 19 nt, Artificial Sequence
  Synthetic oligonucleotide
ucucucccuacaaacugaa

SEQ ID NO: 20222 - RNA, 19 nt, Artificial Sequence
  Synthetic oligonucleotide
cucucccuacaaacugaau

SEQ ID NO: 20223 - RNA, 19 nt, Artificial Sequence
  Synthetic oligonucleotide
ucucccuacaaacugaauu

SEQ ID NO: 20224 - RNA, 19 nt, Artificial Sequence
  Synthetic oligonucleotide
ucccuacaaacugaauuug

SEQ ID NO: 20225 - RNA, 19 nt, Artificial Sequence
  Synthetic oligonucleotide
cccuacaaacugaauuugg

SEQ ID NO: 20226 - RNA, 19 nt, Artificial Sequence
  Synthetic oligonucleotide
ccuacaaacugaauuuggu

SEQ ID NO: 20227 - RNA, 19 nt, Artificial Sequence
  Synthetic oligonucleotide
acaaacugaauuugguugc

SEQ ID NO: 20228 - RNA, 19 nt, Artificial Sequence
  Synthetic oligonucleotide
caaacugaauuugguugcu

SEQ ID NO: 20229 - RNA, 19 nt, Artificial Sequence
  Synthetic oligonucleotide
aaacugaauuugguugcua

SEQ ID NO: 20230 - RNA, 19 nt, Artificial Sequence
  Synthetic oligonucleotide
aacugaauuugguugcuac

SEQ ID NO: 20231 - RNA, 19 nt, Artificial Sequence
  Synthetic oligonucleotide
acugaauuugguugcuacu

SEQ ID NO: 20232 - RNA, 19 nt, Artificial Sequence
  Synthetic oligonucleotide
cugaauuugguugcuacuc

SEQ ID NO: 20233 - RNA, 19 nt, Artificial Sequence
  Synthetic oligonucleotide
ugaauuugguugcuacucc

SEQ ID NO: 20234 - RNA, 19 nt, Artificial Sequence
  Synthetic oligonucleotide
gaauuugguugcuacuccu

SEQ ID NO: 20235 - RNA, 19 nt, Artificial Sequence
  Synthetic oligonucleotide
aauuugguugcuacuccuc

SEQ ID NO: 20236 - RNA, 19 nt, Artificial Sequence
  Synthetic oligonucleotide
auuugguugcuacuccucu

SEQ ID NO: 20237 - RNA, 19 nt, Artificial Sequence
  Synthetic oligonucleotide
uuugguugcuacuccucuu

SEQ ID NO: 20238 - RNA, 19 nt, Artificial Sequence
  Synthetic oligonucleotide
uugguugcuacuccucuuu

SEQ ID NO: 20239 - RNA, 19 nt, Artificial Sequence
  Synthetic oligonucleotide
ugguugcuacuccucuuuu

SEQ ID NO: 20240 - RNA, 19 nt, Artificial Sequence
  Synthetic oligonucleotide
gguugcuacuccucuuuuc

SEQ ID NO: 20241 - RNA, 19 nt, Artificial Sequence
  Synthetic oligonucleotide
guugcuacuccucuuuucc

SEQ ID NO: 20242 - RNA, 19 nt, Artificial Sequence
  Synthetic oligonucleotide
uugcuacuccucuuuuccu

SEQ ID NO: 20243 - RNA, 19 nt, Artificial Sequence
  Synthetic oligonucleotide
ugcuacuccucuuuuccug

SEQ ID NO: 20244 - RNA, 19 nt, Artificial Sequence
  Synthetic oligonucleotide
gcuacuccucuuuuccuga

SEQ ID NO: 20245 - RNA, 19 nt, Artificial Sequence
  Synthetic oligonucleotide
cuacuccucuuuuccugaa

SEQ ID NO: 20246 - RNA, 19 nt, Artificial Sequence
  Synthetic oligonucleotide
uacuccucuuuuccugaag

SEQ ID NO: 20247 - RNA, 19 nt, Artificial Sequence
  Synthetic oligonucleotide
acuccucuuuuccugaagc

SEQ ID NO: 20248 - RNA, 19 nt, Artificial Sequence
  Synthetic oligonucleotide
cuccucuuuuccugaagcc

SEQ ID NO: 20249 - RNA, 19 nt, Artificial Sequence
  Synthetic oligonucleotide
uccucuuuuccugaagccu

SEQ ID NO: 20250 - RNA, 19 nt, Artificial Sequence
  Synthetic oligonucleotide
ccucuuuuccugaagccug

SEQ ID NO: 20251 - RNA, 19 nt, Artificial Sequence
  Synthetic oligonucleotide
cucuuuuccugaagccugg

SEQ ID NO: 20252 - RNA, 19 nt, Artificial Sequence
  Synthetic oligonucleotide
ucuuuuccugaagccuggg

SEQ ID NO: 20253 - RNA, 19 nt, Artificial Sequence
  Synthetic oligonucleotide
cuuuuccugaagccuggga

SEQ ID NO: 20254 - RNA, 19 nt, Artificial Sequence
  Synthetic oligonucleotide
uuuuccugaagccugggau

SEQ ID NO: 20255 - RNA, 19 nt, Artificial Sequence
  Synthetic oligonucleotide
uuuccugaagccugggauu

SEQ ID NO: 20256 - RNA, 19 nt, Artificial Sequence
  Synthetic oligonucleotide
uuccugaagccugggauuc

SEQ ID NO: 20257 - RNA, 19 nt, Artificial Sequence
  Synthetic oligonucleotide
uccugaagccugggauucc

SEQ ID NO: 20258 - RNA, 19 nt, Artificial Sequence
  Synthetic oligonucleotide
ccugaagccugggauucca

SEQ ID NO: 20259 - RNA, 19 nt, Artificial Sequence
  Synthetic oligonucleotide
cugaagccugggauuccau

SEQ ID NO: 20260 - RNA, 19 nt, Artificial Sequence
  Synthetic oligonucleotide
ucccaucaaggugcagguu

SEQ ID NO: 20261 - RNA, 19 nt, Artificial Sequence
  Synthetic oligonucleotide
cccaucaaggugcagguua

SEQ ID NO: 20262 - RNA, 19 nt, Artificial Sequence
  Synthetic oligonucleotide
ccaucaaggugcagguuaa

SEQ ID NO: 20263 - RNA, 19 nt, Artificial Sequence
  Synthetic oligonucleotide
caucaaggugcagguuaaa

SEQ ID NO: 20264 - RNA, 19 nt, Artificial Sequence
  Synthetic oligonucleotide
aucaaggugcagguuaaag

SEQ ID NO: 20265 - RNA, 19 nt, Artificial Sequence
  Synthetic oligonucleotide
uucgcuugaccaguuggua

SEQ ID NO: 20266 - RNA, 19 nt, Artificial Sequence
  Synthetic oligonucleotide
ucgcuugaccaguugguag

SEQ ID NO: 20267 - RNA, 19 nt, Artificial Sequence
  Synthetic oligonucleotide
cgcuugaccaguugguagg

SEQ ID NO: 20268 - RNA, 19 nt, Artificial Sequence
  Synthetic oligonucleotide
gcuugaccaguugguagga

SEQ ID NO: 20269 - RNA, 19 nt, Artificial Sequence
  Synthetic oligonucleotide
gagucccaguaacacugaa

SEQ ID NO: 20270 - RNA, 19 nt, Artificial Sequence
  Synthetic oligonucleotide
agucccaguaacacugaau

SEQ ID NO: 20271 - RNA, 19 nt, Artificial Sequence
  Synthetic oligonucleotide
gucccaguaacacugaaug

SEQ ID NO: 20272 - RNA, 19 nt, Artificial Sequence
  Synthetic oligonucleotide
ucccaguaacacugaaugc

SEQ ID NO: 20273 - RNA, 19 nt, Artificial Sequence
  Synthetic oligonucleotide
cccaguaacacugaaugca

SEQ ID NO: 20274 - RNA, 19 nt, Artificial Sequence
  Synthetic oligonucleotide
ccaguaacacugaaugcac

SEQ ID NO: 20275 - RNA, 19 nt, Artificial Sequence
  Synthetic oligonucleotide
caguaacacugaaugcaca

SEQ ID NO: 20276 - RNA, 19 nt, Artificial Sequence
  Synthetic oligonucleotide
aguaacacugaaugcacaa

SEQ ID NO: 20277 - RNA, 19 nt, Artificial Sequence
  Synthetic oligonucleotide
guaacacugaaugcacaaa

SEQ ID NO: 20278 - RNA, 19 nt, Artificial Sequence
  Synthetic oligonucleotide
uaacacugaaugcacaaac

SEQ ID NO: 20279 - RNA, 19 nt, Artificial Sequence
  Synthetic oligonucleotide
aacacugaaugcacaaaca

SEQ ID NO: 20280 - RNA, 19 nt, Artificial Sequence
  Synthetic oligonucleotide
acacugaaugcacaaacaa

SEQ ID NO: 20281 - RNA, 19 nt, Artificial Sequence
  Synthetic oligonucleotide
cugaaugcacaaacaauug

SEQ ID NO: 20282 - RNA, 19 nt, Artificial Sequence
  Synthetic oligonucleotide
ugaaugcacaaacaauuga

SEQ ID NO: 20283 - RNA, 19 nt, Artificial Sequence
  Synthetic oligonucleotide
gaaugcacaaacaauugau

SEQ ID NO: 20284 - RNA, 19 nt, Artificial Sequence
  Synthetic oligonucleotide
uaaaccaagagacaucuga

SEQ ID NO: 20285 - RNA, 19 nt, Artificial Sequence
  Synthetic oligonucleotide
aaaccaagagacaucugac

SEQ ID NO: 20286 - RNA, 19 nt, Artificial Sequence
  Synthetic oligonucleotide
aaccaagagacaucugacu

SEQ ID NO: 20287 - RNA, 19 nt, Artificial Sequence
  Synthetic oligonucleotide
gcaaaaguguaacacgugu

SEQ ID NO: 20288 - RNA, 19 nt, Artificial Sequence
  Synthetic oligonucleotide
caaaaguguaacacguguu

SEQ ID NO: 20289 - RNA, 19 nt, Artificial Sequence
  Synthetic oligonucleotide
aaaaguguaacacguguug

SEQ ID NO: 20290 - RNA, 19 nt, Artificial Sequence
  Synthetic oligonucleotide
aaaguguaacacguguuga

SEQ ID NO: 20291 - RNA, 19 nt, Artificial Sequence
  Synthetic oligonucleotide
aaguguaacacguguugau

SEQ ID NO: 20292 - RNA, 19 nt, Artificial Sequence
  Synthetic oligonucleotide
aguguaacacguguugaug

SEQ ID NO: 20293 - RNA, 19 nt, Artificial Sequence
  Synthetic oligonucleotide
guguaacacguguugauga

SEQ ID NO: 20294 - RNA, 19 nt, Artificial Sequence
  Synthetic oligonucleotide
uguaacacguguugaugau

SEQ ID NO: 20295 - RNA, 19 nt, Artificial Sequence
  Synthetic oligonucleotide
guaacacguguugaugaug

SEQ ID NO: 20296 - RNA, 19 nt, Artificial Sequence
  Synthetic oligonucleotide
uaacacguguugaugaugg

SEQ ID NO: 20297 - RNA, 19 nt, Artificial Sequence
  Synthetic oligonucleotide
aacacguguugaugaugga

SEQ ID NO: 20298 - RNA, 19 nt, Artificial Sequence
  Synthetic oligonucleotide
acacguguugaugauggag

SEQ ID NO: 20299 - RNA, 19 nt, Artificial Sequence
  Synthetic oligonucleotide
cacguguugaugauggagu

SEQ ID NO: 20300 - RNA, 19 nt, Artificial Sequence
  Synthetic oligonucleotide
acguguugaugauggagua

SEQ ID NO: 20301 - RNA, 19 nt, Artificial Sequence
  Synthetic oligonucleotide
cguguugaugauggaguag

SEQ ID NO: 20302 - RNA, 19 nt, Artificial Sequence
  Synthetic oligonucleotide
guguugaugauggaguagc

SEQ ID NO: 20303 - RNA, 19 nt, Artificial Sequence
  Synthetic oligonucleotide
uguugaugauggaguagcu

SEQ ID NO: 20304 - RNA, 19 nt, Artificial Sequence
  Synthetic oligonucleotide
gcuuaaucucccaucugga

SEQ ID NO: 20305 - RNA, 19 nt, Artificial Sequence
  Synthetic oligonucleotide
cuuaaucucccaucuggag

SEQ ID NO: 20306 - RNA, 19 nt, Artificial Sequence
  Synthetic oligonucleotide
uuaaucucccaucuggagu

SEQ ID NO: 20307 - RNA, 19 nt, Artificial Sequence
  Synthetic oligonucleotide
uaaucucccaucuggagug

SEQ ID NO: 20308 - RNA, 19 nt, Artificial Sequence
  Synthetic oligonucleotide
aaucucccaucuggaguga

SEQ ID NO: 20309 - RNA, 19 nt, Artificial Sequence
  Synthetic oligonucleotide
ucucccaucuggagugacg

SEQ ID NO: 20310 - RNA, 19 nt, Artificial Sequence
  Synthetic oligonucleotide
ucccaucuggagugacggu

SEQ ID NO: 20311 - RNA, 19 nt, Artificial Sequence
  Synthetic oligonucleotide
cccaucuggagugacggug

SEQ ID NO: 20312 - RNA, 19 nt, Artificial Sequence
  Synthetic oligonucleotide
ccaucuggagugacggugc

SEQ ID NO: 20313 - RNA, 19 nt, Artificial Sequence
  Synthetic oligonucleotide
caucuggagugacggugcu

SEQ ID NO: 20314 - RNA, 19 nt, Artificial Sequence
  Synthetic oligonucleotide
aucuggagugacggugcug

SEQ ID NO: 20315 - RNA, 19 nt, Artificial Sequence
  Synthetic oligonucleotide
ucuggagugacggugcugg

SEQ ID NO: 20316 - RNA, 19 nt, Artificial Sequence
  Synthetic oligonucleotide
cuggagugacggugcugga

SEQ ID NO: 20317 - RNA, 19 nt, Artificial Sequence
  Synthetic oligonucleotide
uggagugacggugcuggag

SEQ ID NO: 20318 - RNA, 19 nt, Artificial Sequence
  Synthetic oligonucleotide
ggagugacggugcuggagu

SEQ ID NO: 20319 - RNA, 19 nt, Artificial Sequence
  Synthetic oligonucleotide
gagugacggugcuggaguu

SEQ ID NO: 20320 - RNA, 19 nt, Artificial Sequence
  Synthetic oligonucleotide
agugacggugcuggaguuu

SEQ ID NO: 20321 - RNA, 19 nt, Artificial Sequence
  Synthetic oligonucleotide
gugacggugcuggaguuua

SEQ ID NO: 20322 - RNA, 19 nt, Artificial Sequence
  Synthetic oligonucleotide
ugacggugcuggaguuuaa

SEQ ID NO: 20323 - RNA, 19 nt, Artificial Sequence
  Synthetic oligonucleotide
gacggugcuggaguuuaau

SEQ ID NO: 20324 - RNA, 19 nt, Artificial Sequence
  Synthetic oligonucleotide
acggugcuggaguuuaaug

SEQ ID NO: 20325 - RNA, 19 nt, Artificial Sequence
  Synthetic oligonucleotide
cggugcuggaguuuaaugu

SEQ ID NO: 20326 - RNA, 19 nt, Artificial Sequence
  Synthetic oligonucleotide
ggugcuggaguuuaauguc

SEQ ID NO: 20327 - RNA, 19 nt, Artificial Sequence
  Synthetic oligonucleotide
gugcuggaguuuaauguca

SEQ ID NO: 20328 - RNA, 19 nt, Artificial Sequence
  Synthetic oligonucleotide
ugcuggaguuuaaugucaa

SEQ ID NO: 20329 - RNA, 19 nt, Artificial Sequence
  Synthetic oligonucleotide
gcuggaguuuaaugucaaa

SEQ ID NO: 20330 - RNA, 19 nt, Artificial Sequence
  Synthetic oligonucleotide
cuggaguuuaaugucaaaa

SEQ ID NO: 20331 - RNA, 19 nt, Artificial Sequence
  Synthetic oligonucleotide
uggaguuuaaugucaaaac

SEQ ID NO: 20332 - RNA, 19 nt, Artificial Sequence
  Synthetic oligonucleotide
ggaguuuaaugucaaaacu

SEQ ID NO: 20333 - RNA, 19 nt, Artificial Sequence
  Synthetic oligonucleotide
gaguuuaaugucaaaacug

SEQ ID NO: 20334 - RNA, 19 nt, Artificial Sequence
  Synthetic oligonucleotide
aguuuaaugucaaaacuga

SEQ ID NO: 20335 - RNA, 19 nt, Artificial Sequence
  Synthetic oligonucleotide
guuuaaugucaaaacugau

SEQ ID NO: 20336 - RNA, 19 nt, Artificial Sequence
  Synthetic oligonucleotide
uuuaaugucaaaacugaug

SEQ ID NO: 20337 - RNA, 19 nt, Artificial Sequence
  Synthetic oligonucleotide
uuaaugucaaaacugaugc

SEQ ID NO: 20338 - RNA, 19 nt, Artificial Sequence
  Synthetic oligonucleotide
uaaugucaaaacugaugcu

SEQ ID NO: 20339 - RNA, 19 nt, Artificial Sequence
  Synthetic oligonucleotide
aaugucaaaacugaugcuc

SEQ ID NO: 20340 - RNA, 19 nt, Artificial Sequence
  Synthetic oligonucleotide
augucaaaacugaugcucc

SEQ ID NO: 20341 - RNA, 19 nt, Artificial Sequence
  Synthetic oligonucleotide
ugucaaaacugaugcucca

SEQ ID NO: 20342 - RNA, 19 nt, Artificial Sequence
  Synthetic oligonucleotide
gucaaaacugaugcuccag

SEQ ID NO: 20343 - RNA, 19 nt, Artificial Sequence
  Synthetic oligonucleotide
ucaaaacugaugcuccaga

SEQ ID NO: 20344 - RNA, 19 nt, Artificial Sequence
  Synthetic oligonucleotide
caaaacugaugcuccagau

SEQ ID NO: 20345 - RNA, 19 nt, Artificial Sequence
  Synthetic oligonucleotide
aaaacugaugcuccagauc

SEQ ID NO: 20346 - RNA, 19 nt, Artificial Sequence
  Synthetic oligonucleotide
aaacugaugcuccagaucu

SEQ ID NO: 20347 - RNA, 19 nt, Artificial Sequence
  Synthetic oligonucleotide
aacugaugcuccagaucuu

SEQ ID NO: 20348 - RNA, 19 nt, Artificial Sequence
  Synthetic oligonucleotide
acugaugcuccagaucuuc

SEQ ID NO: 20349 - RNA, 19 nt, Artificial Sequence
  Synthetic oligonucleotide
cugaugcuccagaucuucc

SEQ ID NO: 20350 - RNA, 19 nt, Artificial Sequence
  Synthetic oligonucleotide
ugaugcuccagaucuucca

SEQ ID NO: 20351 - RNA, 19 nt, Artificial Sequence
  Synthetic oligonucleotide
aagaaaaucaggccaggga

SEQ ID NO: 20352 - RNA, 19 nt, Artificial Sequence
  Synthetic oligonucleotide
agaaaaucaggccagggaa

SEQ ID NO: 20353 - RNA, 19 nt, Artificial Sequence
  Synthetic oligonucleotide
gaaaaucaggccagggaag

SEQ ID NO: 20354 - RNA, 19 nt, Artificial Sequence
  Synthetic oligonucleotide
aaaaucaggccagggaagg

SEQ ID NO: 20355 - RNA, 19 nt, Artificial Sequence
  Synthetic oligonucleotide
aaaucaggccagggaaggu

SEQ ID NO: 20356 - RNA, 19 nt, Artificial Sequence
  Synthetic oligonucleotide
aaucaggccagggaagguu

SEQ ID NO: 20357 - RNA, 19 nt, Artificial Sequence
  Synthetic oligonucleotide
aucaggccagggaagguua

SEQ ID NO: 20358 - RNA, 19 nt, Artificial Sequence
  Synthetic oligonucleotide
ucaggccagggaagguuac

SEQ ID NO: 20359 - RNA, 19 nt, Artificial Sequence
  Synthetic oligonucleotide
caggccagggaagguuacc

SEQ ID NO: 20360 - RNA, 19 nt, Artificial Sequence
  Synthetic oligonucleotide
aggccagggaagguuaccg

SEQ ID NO: 20361 - RNA, 19 nt, Artificial Sequence
  Synthetic oligonucleotide
ggccagggaagguuaccga

SEQ ID NO: 20362 - RNA, 19 nt, Artificial Sequence
  Synthetic oligonucleotide
gccagggaagguuaccgag

SEQ ID NO: 20363 - RNA, 19 nt, Artificial Sequence
  Synthetic oligonucleotide
ccagggaagguuaccgagc

SEQ ID NO: 20364 - RNA, 19 nt, Artificial Sequence
  Synthetic oligonucleotide
cagggaagguuaccgagca

SEQ ID NO: 20365 - RNA, 19 nt, Artificial Sequence
  Synthetic oligonucleotide
agggaagguuaccgagcaa

SEQ ID NO: 20366 - RNA, 19 nt, Artificial Sequence
  Synthetic oligonucleotide
gggaagguuaccgagcaau

SEQ ID NO: 20367 - RNA, 19 nt, Artificial Sequence
  Synthetic oligonucleotide
ggaagguuaccgagcaaua

SEQ ID NO: 20368 - RNA, 19 nt, Artificial Sequence
  Synthetic oligonucleotide
gaagguuaccgagcaauag

SEQ ID NO: 20369 - RNA, 19 nt, Artificial Sequence
  Synthetic oligonucleotide
agguuaccgagcaauagca

SEQ ID NO: 20370 - RNA, 19 nt, Artificial Sequence
  Synthetic oligonucleotide
gguuaccgagcaauagcau

SEQ ID NO: 20371 - RNA, 19 nt, Artificial Sequence
  Synthetic oligonucleotide
guuaccgagcaauagcaua

SEQ ID NO: 20372 - RNA, 19 nt, Artificial Sequence
  Synthetic oligonucleotide
uuaccgagcaauagcauac

SEQ ID NO: 20373 - RNA, 19 nt, Artificial Sequence
  Synthetic oligonucleotide
uaccgagcaauagcauacu

SEQ ID NO: 20374 - RNA, 19 nt, Artificial Sequence
  Synthetic oligonucleotide
accgagcaauagcauacuc

SEQ ID NO: 20375 - RNA, 19 nt, Artificial Sequence
  Synthetic oligonucleotide
ccgagcaauagcauacuca

SEQ ID NO: 20376 - RNA, 19 nt, Artificial Sequence
  Synthetic oligonucleotide
cgagcaauagcauacucau

SEQ ID NO: 20377 - RNA, 19 nt, Artificial Sequence
  Synthetic oligonucleotide
gagcaauagcauacucauc

SEQ ID NO: 20378 - RNA, 19 nt, Artificial Sequence
  Synthetic oligonucleotide
agcaauagcauacucaucu

SEQ ID NO: 20379 - RNA, 19 nt, Artificial Sequence
  Synthetic oligonucleotide
gcaauagcauacucaucuc

SEQ ID NO: 20380 - RNA, 19 nt, Artificial Sequence
  Synthetic oligonucleotide
caauagcauacucaucucu

SEQ ID NO: 20381 - RNA, 19 nt, Artificial Sequence
  Synthetic oligonucleotide
aauagcauacucaucucuc

SEQ ID NO: 20382 - RNA, 19 nt, Artificial Sequence
  Synthetic oligonucleotide
auagcauacucaucucuca

SEQ ID NO: 20383 - RNA, 19 nt, Artificial Sequence
  Synthetic oligonucleotide
uagcauacucaucucucag

SEQ ID NO: 20384 - RNA, 19 nt, Artificial Sequence
  Synthetic oligonucleotide
agcauacucaucucucagc

SEQ ID NO: 20385 - RNA, 19 nt, Artificial Sequence
  Synthetic oligonucleotide
gcauacucaucucucagcc

SEQ ID NO: 20386 - RNA, 19 nt, Artificial Sequence
  Synthetic oligonucleotide
cauacucaucucucagcca

SEQ ID NO: 20387 - RNA, 19 nt, Artificial Sequence
  Synthetic oligonucleotide
auacucaucucucagccaa

SEQ ID NO: 20388 - RNA, 19 nt, Artificial Sequence
  Synthetic oligonucleotide
uacucaucucucagccaaa

SEQ ID NO: 20389 - RNA, 19 nt, Artificial Sequence
  Synthetic oligonucleotide
acucaucucucagccaaag

SEQ ID NO: 20390 - RNA, 19 nt, Artificial Sequence
  Synthetic oligonucleotide
cucaucucucagccaaagu

SEQ ID NO: 20391 - RNA, 19 nt, Artificial Sequence
  Synthetic oligonucleotide
ucaucucucagccaaaguu

SEQ ID NO: 20392 - RNA, 19 nt, Artificial Sequence
  Synthetic oligonucleotide
caucucucagccaaaguua

SEQ ID NO: 20393 - RNA, 19 nt, Artificial Sequence
  Synthetic oligonucleotide
aucucucagccaaaguuac

SEQ ID NO: 20394 - RNA, 19 nt, Artificial Sequence
  Synthetic oligonucleotide
ucucucagccaaaguuacc

SEQ ID NO: 20395 - RNA, 19 nt, Artificial Sequence
  Synthetic oligonucleotide
cucucagccaaaguuaccu

SEQ ID NO: 20396 - RNA, 19 nt, Artificial Sequence
  Synthetic oligonucleotide
auaaggcuuugcuaguggg

SEQ ID NO: 20397 - RNA, 19 nt, Artificial Sequence
  Synthetic oligonucleotide
uaaggcuuugcuaguggga

SEQ ID NO: 20398 - RNA, 19 nt, Artificial Sequence
  Synthetic oligonucleotide
aaggcuuugcuagugggag

SEQ ID NO: 20399 - RNA, 19 nt, Artificial Sequence
  Synthetic oligonucleotide
ccccaaaagcccauauauu

SEQ ID NO: 20400 - RNA, 19 nt, Artificial Sequence
  Synthetic oligonucleotide
cccaaaagcccauauauug

SEQ ID NO: 20401 - RNA, 19 nt, Artificial Sequence
  Synthetic oligonucleotide
caaaagcccauauauugac

SEQ ID NO: 20402 - RNA, 19 nt, Artificial Sequence
  Synthetic oligonucleotide
aaaagcccauauauugaca

SEQ ID NO: 20403 - RNA, 19 nt, Artificial Sequence
  Synthetic oligonucleotide
aaagcccauauauugacaa

SEQ ID NO: 20404 - RNA, 19 nt, Artificial Sequence
  Synthetic oligonucleotide
gcccauauauugacaaaau

SEQ ID NO: 20405 - RNA, 19 nt, Artificial Sequence
  Synthetic oligonucleotide
auauauugacaaaauaacu

SEQ ID NO: 20406 - RNA, 19 nt, Artificial Sequence
  Synthetic oligonucleotide
uauauugacaaaauaacuc

SEQ ID NO: 20407 - RNA, 19 nt, Artificial Sequence
  Synthetic oligonucleotide
uauugacaaaauaacucac

SEQ ID NO: 20408 - RNA, 19 nt, Artificial Sequence
  Synthetic oligonucleotide
auuacuugauuuuauccaa

SEQ ID NO: 20409 - RNA, 19 nt, Artificial Sequence
  Synthetic oligonucleotide
uuacuugauuuuauccaag

SEQ ID NO: 20410 - RNA, 19 nt, Artificial Sequence
  Synthetic oligonucleotide
uacuugauuuuauccaagg

SEQ ID NO: 20411 - RNA, 19 nt, Artificial Sequence
  Synthetic oligonucleotide
acuugauuuuauccaaggg

SEQ ID NO: 20412 - RNA, 19 nt, Artificial Sequence
  Synthetic oligonucleotide
cuugauuuuauccaagggc

SEQ ID NO: 20413 - RNA, 19 nt, Artificial Sequence
  Synthetic oligonucleotide
uugauuuuauccaagggca

SEQ ID NO: 20414 - RNA, 19 nt, Artificial Sequence
  Synthetic oligonucleotide
ugauuuuauccaagggcaa

SEQ ID NO: 20415 - RNA, 19 nt, Artificial Sequence
  Synthetic oligonucleotide
gauuuuauccaagggcaaa

SEQ ID NO: 20416 - RNA, 19 nt, Artificial Sequence
  Synthetic oligonucleotide
auuuuauccaagggcaaaa

SEQ ID NO: 20417 - RNA, 19 nt, Artificial Sequence
  Synthetic oligonucleotide
uuuuauccaagggcaaaau

SEQ ID NO: 20418 - RNA, 19 nt, Artificial Sequence
  Synthetic oligonucleotide
uuuauccaagggcaaaauu

SEQ ID NO: 20419 - RNA, 19 nt, Artificial Sequence
  Synthetic oligonucleotide
uuauccaagggcaaaauua

SEQ ID NO: 20420 - RNA, 19 nt, Artificial Sequence
  Synthetic oligonucleotide
uauccaagggcaaaauuau

SEQ ID NO: 20421 - RNA, 19 nt, Artificial Sequence
  Synthetic oligonucleotide
auccaagggcaaaauuauc

SEQ ID NO: 20422 - RNA, 19 nt, Artificial Sequence
  Synthetic oligonucleotide
uccaagggcaaaauuaucc

SEQ ID NO: 20423 - RNA, 19 nt, Artificial Sequence
  Synthetic oligonucleotide
ccaagggcaaaauuaucca

SEQ ID NO: 20424 - RNA, 19 nt, Artificial Sequence
  Synthetic oligonucleotide
caagggcaaaauuauccac

SEQ ID NO: 20425 - RNA, 19 nt, Artificial Sequence
  Synthetic oligonucleotide
aagggcaaaauuauccacu

SEQ ID NO: 20426 - RNA, 19 nt, Artificial Sequence
  Synthetic oligonucleotide
agggcaaaauuauccacuu

SEQ ID NO: 20427 - RNA, 19 nt, Artificial Sequence
  Synthetic oligonucleotide
gggcaaaauuauccacuuu

SEQ ID NO: 20428 - RNA, 19 nt, Artificial Sequence
  Synthetic oligonucleotide
ggcaaaauuauccacuuug

SEQ ID NO: 20429 - RNA, 19 nt, Artificial Sequence
  Synthetic oligonucleotide
gcaaaauuauccacuuugg

SEQ ID NO: 20430 - RNA, 19 nt, Artificial Sequence
  Synthetic oligonucleotide
caaaauuauccacuuuggc

SEQ ID NO: 20431 - RNA, 19 nt, Artificial Sequence
  Synthetic oligonucleotide
auuuucagaugcaucuuau

SEQ ID NO: 20432 - RNA, 19 nt, Artificial Sequence
  Synthetic oligonucleotide
uuuucagaugcaucuuauc

SEQ ID NO: 20433 - RNA, 19 nt, Artificial Sequence
  Synthetic oligonucleotide
uuucagaugcaucuuauca

SEQ ID NO: 20434 - RNA, 19 nt, Artificial Sequence
  Synthetic oligonucleotide
uucagaugcaucuuaucaa

SEQ ID NO: 20435 - RNA, 19 nt, Artificial Sequence
  Synthetic oligonucleotide
ucagaugcaucuuaucaaa

SEQ ID NO: 20436 - RNA, 19 nt, Artificial Sequence
  Synthetic oligonucleotide
cagaugcaucuuaucaaag

SEQ ID NO: 20437 - RNA, 19 nt, Artificial Sequence
  Synthetic oligonucleotide
agaugcaucuuaucaaagu

SEQ ID NO: 20438 - RNA, 19 nt, Artificial Sequence
  Synthetic oligonucleotide
gaugcaucuuaucaaagua

SEQ ID NO: 20439 - RNA, 19 nt, Artificial Sequence
  Synthetic oligonucleotide
augcaucuuaucaaaguau

SEQ ID NO: 20440 - RNA, 19 nt, Artificial Sequence
  Synthetic oligonucleotide
ugcaucuuaucaaaguaua

SEQ ID NO: 20441 - RNA, 19 nt, Artificial Sequence
  Synthetic oligonucleotide
gcaucuuaucaaaguauaa

SEQ ID NO: 20442 - RNA, 19 nt, Artificial Sequence
  Synthetic oligonucleotide
caucuuaucaaaguauaaa

SEQ ID NO: 20443 - RNA, 19 nt, Artificial Sequence
  Synthetic oligonucleotide
aucuuaucaaaguauaaac

SEQ ID NO: 20444 - RNA, 19 nt, Artificial Sequence
  Synthetic oligonucleotide
ucuuaucaaaguauaaaca

SEQ ID NO: 20445 - RNA, 19 nt, Artificial Sequence
  Synthetic oligonucleotide
cuuaucaaaguauaaacau

SEQ ID NO: 20446 - RNA, 19 nt, Artificial Sequence
  Synthetic oligonucleotide
uuaucaaaguauaaacauu

SEQ ID NO: 20447 - RNA, 19 nt, Artificial Sequence
  Synthetic oligonucleotide
uaucaaaguauaaacauuc

SEQ ID NO: 20448 - RNA, 19 nt, Artificial Sequence
  Synthetic oligonucleotide
aucaaaguauaaacauucc

SEQ ID NO: 20449 - RNA, 19 nt, Artificial Sequence
  Synthetic oligonucleotide
cacagaacaugguuccuuc

SEQ ID NO: 20450 - RNA, 19 nt, Artificial Sequence
  Synthetic oligonucleotide
acagaacaugguuccuuca

SEQ ID NO: 20451 - RNA, 19 nt, Artificial Sequence
  Synthetic oligonucleotide
cagaacaugguuccuucau

SEQ ID NO: 20452 - RNA, 19 nt, Artificial Sequence
  Synthetic oligonucleotide
agaacaugguuccuucauc

SEQ ID NO: 20453 - RNA, 19 nt, Artificial Sequence
  Synthetic oligonucleotide
gaacaugguuccuucaucc

SEQ ID NO: 20454 - RNA, 19 nt, Artificial Sequence
  Synthetic oligonucleotide
aacaugguuccuucauccc

SEQ ID NO: 20455 - RNA, 19 nt, Artificial Sequence
  Synthetic oligonucleotide
acaugguuccuucaucccg

SEQ ID NO: 20456 - RNA, 19 nt, Artificial Sequence
  Synthetic oligonucleotide
caugguuccuucaucccga

SEQ ID NO: 20457 - RNA, 19 nt, Artificial Sequence
  Synthetic oligonucleotide
uucuggucuauuacaucgu

SEQ ID NO: 20458 - RNA, 19 nt, Artificial Sequence
  Synthetic oligonucleotide
ucuggucuauuacaucguc

SEQ ID NO: 20459 - RNA, 19 nt, Artificial Sequence
  Synthetic oligonucleotide
cuggucuauuacaucguca

SEQ ID NO: 20460 - RNA, 19 nt, Artificial Sequence
  Synthetic oligonucleotide
uggucuauuacaucgucac

SEQ ID NO: 20461 - RNA, 19 nt, Artificial Sequence
  Synthetic oligonucleotide
ggucuauuacaucgucaca

SEQ ID NO: 20462 - RNA, 19 nt, Artificial Sequence
  Synthetic oligonucleotide
gucuauuacaucgucacag

SEQ ID NO: 20463 - RNA, 19 nt, Artificial Sequence
  Synthetic oligonucleotide
ucuauuacaucgucacagg

SEQ ID NO: 20464 - RNA, 19 nt, Artificial Sequence
  Synthetic oligonucleotide
cuauuacaucgucacagga

SEQ ID NO: 20465 - RNA, 19 nt, Artificial Sequence
  Synthetic oligonucleotide
aacagacagcagaauuagu

SEQ ID NO: 20466 - RNA, 19 nt, Artificial Sequence
  Synthetic oligonucleotide
acagacagcagaauuagug

SEQ ID NO: 20467 - RNA, 19 nt, Artificial Sequence
  Synthetic oligonucleotide
cagacagcagaauuagugu

SEQ ID NO: 20468 - RNA, 19 nt, Artificial Sequence
  Synthetic oligonucleotide
agacagcagaauuaguguc

SEQ ID NO: 20469 - RNA, 19 nt, Artificial Sequence
  Synthetic oligonucleotide
gacagcagaauuagugucu

SEQ ID NO: 20470 - RNA, 19 nt, Artificial Sequence
  Synthetic oligonucleotide
acagcagaauuagugucug

SEQ ID NO: 20471 - RNA, 19 nt, Artificial Sequence
  Synthetic oligonucleotide
cagcagaauuagugucuga

SEQ ID NO: 20472 - RNA, 19 nt, Artificial Sequence
  Synthetic oligonucleotide
agcagaauuagugucugau

SEQ ID NO: 20473 - RNA, 19 nt, Artificial Sequence
  Synthetic oligonucleotide
gcagaauuagugucugauu

SEQ ID NO: 20474 - RNA, 19 nt, Artificial Sequence
  Synthetic oligonucleotide
cagaauuagugucugauuc

SEQ ID NO: 20475 - RNA, 19 nt, Artificial Sequence
  Synthetic oligonucleotide
agaauuagugucugauuca

SEQ ID NO: 20476 - RNA, 19 nt, Artificial Sequence
  Synthetic oligonucleotide
gaauuagugucugauucag

SEQ ID NO: 20477 - RNA, 19 nt, Artificial Sequence
  Synthetic oligonucleotide
aauuagugucugauucagu

SEQ ID NO: 20478 - RNA, 19 nt, Artificial Sequence
  Synthetic oligonucleotide
auuagugucugauucaguc

SEQ ID NO: 20479 - RNA, 19 nt, Artificial Sequence
  Synthetic oligonucleotide
uuagugucugauucagucu

SEQ ID NO: 20480 - RNA, 19 nt, Artificial Sequence
  Synthetic oligonucleotide
uagugucugauucagucug

SEQ ID NO: 20481 - RNA, 19 nt, Artificial Sequence
  Synthetic oligonucleotide
agugucugauucagucugg

SEQ ID NO: 20482 - RNA, 19 nt, Artificial Sequence
  Synthetic oligonucleotide
ugucugauucagucugguu

SEQ ID NO: 20483 - RNA, 19 nt, Artificial Sequence
  Synthetic oligonucleotide
gauucagucugguuaaaua

SEQ ID NO: 20484 - RNA, 19 nt, Artificial Sequence
  Synthetic oligonucleotide
ugguuaaauauugaagaaa

SEQ ID NO: 20485 - RNA, 19 nt, Artificial Sequence
  Synthetic oligonucleotide
gguuaaauauugaagaaaa

SEQ ID NO: 20486 - RNA, 19 nt, Artificial Sequence
  Synthetic oligonucleotide
guuaaauauugaagaaaaa

SEQ ID NO: 20487 - RNA, 19 nt, Artificial Sequence
  Synthetic oligonucleotide
uuaaauauugaagaaaaau

SEQ ID NO: 20488 - RNA, 19 nt, Artificial Sequence
  Synthetic oligonucleotide
uaaauauugaagaaaaaug

SEQ ID NO: 20489 - RNA, 19 nt, Artificial Sequence
  Synthetic oligonucleotide
aaauauugaagaaaaaugu

SEQ ID NO: 20490 - RNA, 19 nt, Artificial Sequence
  Synthetic oligonucleotide
aauauugaagaaaaaugug

SEQ ID NO: 20491 - RNA, 19 nt, Artificial Sequence
  Synthetic oligonucleotide
auauugaagaaaaaugugg

SEQ ID NO: 20492 - RNA, 19 nt, Artificial Sequence
  Synthetic oligonucleotide
uauugaagaaaaauguggc

SEQ ID NO: 20493 - RNA, 19 nt, Artificial Sequence
  Synthetic oligonucleotide
auugaagaaaaauguggca

SEQ ID NO: 20494 - RNA, 19 nt, Artificial Sequence
  Synthetic oligonucleotide
uugaagaaaaauguggcaa

SEQ ID NO: 20495 - RNA, 19 nt, Artificial Sequence
  Synthetic oligonucleotide
ugaagaaaaauguggcaac

SEQ ID NO: 20496 - RNA, 19 nt, Artificial Sequence
  Synthetic oligonucleotide
gaagaaaaauguggcaacc

SEQ ID NO: 20497 - RNA, 19 nt, Artificial Sequence
  Synthetic oligonucleotide
aagaaaaauguggcaacca

SEQ ID NO: 20498 - RNA, 19 nt, Artificial Sequence
  Synthetic oligonucleotide
agaaaaauguggcaaccag

SEQ ID NO: 20499 - RNA, 19 nt, Artificial Sequence
  Synthetic oligonucleotide
gaaaaauguggcaaccagc

SEQ ID NO: 20500 - RNA, 19 nt, Artificial Sequence
  Synthetic oligonucleotide
aaaaauguggcaaccagcu

SEQ ID NO: 20501 - RNA, 19 nt, Artificial Sequence
  Synthetic oligonucleotide
aaaauguggcaaccagcuc

SEQ ID NO: 20502 - RNA, 19 nt, Artificial Sequence
  Synthetic oligonucleotide
aaauguggcaaccagcucc

SEQ ID NO: 20503 - RNA, 19 nt, Artificial Sequence
  Synthetic oligonucleotide
uguggcaaccagcuccagg

SEQ ID NO: 20504 - RNA, 19 nt, Artificial Sequence
  Synthetic oligonucleotide
guggcaaccagcuccaggu

SEQ ID NO: 20505 - RNA, 19 nt, Artificial Sequence
  Synthetic oligonucleotide
uggcaaccagcuccagguu

SEQ ID NO: 20506 - RNA, 19 nt, Artificial Sequence
  Synthetic oligonucleotide
ggcaaccagcuccagguuc

SEQ ID NO: 20507 - RNA, 19 nt, Artificial Sequence
  Synthetic oligonucleotide
gcaaccagcuccagguuca

SEQ ID NO: 20508 - RNA, 19 nt, Artificial Sequence
  Synthetic oligonucleotide
caaccagcuccagguucau

SEQ ID NO: 20509 - RNA, 19 nt, Artificial Sequence
  Synthetic oligonucleotide
aaccagcuccagguucauc

SEQ ID NO: 20510 - RNA, 19 nt, Artificial Sequence
  Synthetic oligonucleotide
accagcuccagguucaucu

SEQ ID NO: 20511 - RNA, 19 nt, Artificial Sequence
  Synthetic oligonucleotide
ccagcuccagguucaucug

SEQ ID NO: 20512 - RNA, 19 nt, Artificial Sequence
  Synthetic oligonucleotide
cagcuccagguucaucugu

SEQ ID NO: 20513 - RNA, 19 nt, Artificial Sequence
  Synthetic oligonucleotide
agcuccagguucaucuguc

SEQ ID NO: 20514 - RNA, 19 nt, Artificial Sequence
  Synthetic oligonucleotide
gcuccagguucaucugucu

SEQ ID NO: 20515 - RNA, 19 nt, Artificial Sequence
  Synthetic oligonucleotide
cuccagguucaucugucuc

SEQ ID NO: 20516 - RNA, 19 nt, Artificial Sequence
  Synthetic oligonucleotide
uccagguucaucugucucc

SEQ ID NO: 20517 - RNA, 19 nt, Artificial Sequence
  Synthetic oligonucleotide
ccagguucaucugucuccu

SEQ ID NO: 20518 - RNA, 19 nt, Artificial Sequence
  Synthetic oligonucleotide
cagguucaucugucuccug

SEQ ID NO: 20519 - RNA, 19 nt, Artificial Sequence
  Synthetic oligonucleotide
agguucaucugucuccuga

SEQ ID NO: 20520 - RNA, 19 nt, Artificial Sequence
  Synthetic oligonucleotide
gguucaucugucuccugau

SEQ ID NO: 20521 - RNA, 19 nt, Artificial Sequence
  Synthetic oligonucleotide
guucaucugucuccugaug

SEQ ID NO: 20522 - RNA, 19 nt, Artificial Sequence
  Synthetic oligonucleotide
uucaucugucuccugaugc

SEQ ID NO: 20523 - RNA, 19 nt, Artificial Sequence
  Synthetic oligonucleotide
ucaucugucuccugaugca

SEQ ID NO: 20524 - RNA, 19 nt, Artificial Sequence
  Synthetic oligonucleotide
caucugucuccugaugcag

SEQ ID NO: 20525 - RNA, 19 nt, Artificial Sequence
  Synthetic oligonucleotide
gaauggauuccuggguggc

SEQ ID NO: 20526 - RNA, 19 nt, Artificial Sequence
  Synthetic oligonucleotide
aauggauuccuggguggca

SEQ ID NO: 20527 - RNA, 19 nt, Artificial Sequence
  Synthetic oligonucleotide
auggauuccuggguggcau

SEQ ID NO: 20528 - RNA, 19 nt, Artificial Sequence
  Synthetic oligonucleotide
aggagccaaaaagcccuug

SEQ ID NO: 20529 - RNA, 19 nt, Artificial Sequence
  Synthetic oligonucleotide
ggagccaaaaagcccuugg

SEQ ID NO: 20530 - RNA, 19 nt, Artificial Sequence
  Synthetic oligonucleotide
gagccaaaaagcccuugga

SEQ ID NO: 20531 - RNA, 19 nt, Artificial Sequence
  Synthetic oligonucleotide
agccaaaaagcccuuggaa

SEQ ID NO: 20532 - RNA, 19 nt, Artificial Sequence
  Synthetic oligonucleotide
gccaaaaagcccuuggaaa

SEQ ID NO: 20533 - RNA, 19 nt, Artificial Sequence
  Synthetic oligonucleotide
ccaaaaagcccuuggaaag

SEQ ID NO: 20534 - RNA, 19 nt, Artificial Sequence
  Synthetic oligonucleotide
caaaaagcccuuggaaaga

SEQ ID NO: 20535 - RNA, 19 nt, Artificial Sequence
  Synthetic oligonucleotide
aaaaagcccuuggaaagag

SEQ ID NO: 20536 - RNA, 19 nt, Artificial Sequence
  Synthetic oligonucleotide
aaaagcccuuggaaagagu

SEQ ID NO: 20537 - RNA, 19 nt, Artificial Sequence
  Synthetic oligonucleotide
aaagcccuuggaaagagua

SEQ ID NO: 20538 - RNA, 19 nt, Artificial Sequence
  Synthetic oligonucleotide
aagcccuuggaaagaguau

SEQ ID NO: 20539 - RNA, 19 nt, Artificial Sequence
  Synthetic oligonucleotide
agcccuuggaaagaguauu

SEQ ID NO: 20540 - RNA, 19 nt, Artificial Sequence
  Synthetic oligonucleotide
gcccuuggaaagaguauuu

SEQ ID NO: 20541 - RNA, 19 nt, Artificial Sequence
  Synthetic oligonucleotide
cccuuggaaagaguauuuc

SEQ ID NO: 20542 - RNA, 19 nt, Artificial Sequence
  Synthetic oligonucleotide
ccuuggaaagaguauuuca

SEQ ID NO: 20543 - RNA, 19 nt, Artificial Sequence
  Synthetic oligonucleotide
cuuggaaagaguauuucaa

SEQ ID NO: 20544 - RNA, 19 nt, Artificial Sequence
  Synthetic oligonucleotide
uuggaaagaguauuucaau

SEQ ID NO: 20545 - RNA, 19 nt, Artificial Sequence
  Synthetic oligonucleotide
uggaaagaguauuucaauu

SEQ ID NO: 20546 - RNA, 19 nt, Artificial Sequence
  Synthetic oligonucleotide
ggaaagaguauuucaauuc

SEQ ID NO: 20547 - RNA, 19 nt, Artificial Sequence
  Synthetic oligonucleotide
gaaagaguauuucaauucu

SEQ ID NO: 20548 - RNA, 19 nt, Artificial Sequence
  Synthetic oligonucleotide
aaagaguauuucaauucuu

SEQ ID NO: 20549 - RNA, 19 nt, Artificial Sequence
  Synthetic oligonucleotide
aagaguauuucaauucuua

SEQ ID NO: 20550 - RNA, 19 nt, Artificial Sequence
  Synthetic oligonucleotide
agaguauuucaauucuuag

SEQ ID NO: 20551 - RNA, 19 nt, Artificial Sequence
  Synthetic oligonucleotide
gaguauuucaauucuuaga

SEQ ID NO: 20552 - RNA, 19 nt, Artificial Sequence
  Synthetic oligonucleotide
aguauuucaauucuuagag

SEQ ID NO: 20553 - RNA, 19 nt, Artificial Sequence
  Synthetic oligonucleotide
guauuucaauucuuagaga

SEQ ID NO: 20554 - RNA, 19 nt, Artificial Sequence
  Synthetic oligonucleotide
uauuucaauucuuagagaa

SEQ ID NO: 20555 - RNA, 19 nt, Artificial Sequence
  Synthetic oligonucleotide
auuucaauucuuagagaag

SEQ ID NO: 20556 - RNA, 19 nt, Artificial Sequence
  Synthetic oligonucleotide
uuucaauucuuagagaaga

SEQ ID NO: 20557 - RNA, 19 nt, Artificial Sequence
  Synthetic oligonucleotide
uucaauucuuagagaagag

SEQ ID NO: 20558 - RNA, 19 nt, Artificial Sequence
  Synthetic oligonucleotide
ucaauucuuagagaagagu

SEQ ID NO: 20559 - RNA, 19 nt, Artificial Sequence
  Synthetic oligonucleotide
caauucuuagagaagagug

SEQ ID NO: 20560 - RNA, 19 nt, Artificial Sequence
  Synthetic oligonucleotide
aauucuuagagaagaguga

SEQ ID NO: 20561 - RNA, 19 nt, Artificial Sequence
  Synthetic oligonucleotide
uucuuagagaagagugauc

SEQ ID NO: 20562 - RNA, 19 nt, Artificial Sequence
  Synthetic oligonucleotide
ucuuagagaagagugaucu

SEQ ID NO: 20563 - RNA, 19 nt, Artificial Sequence
  Synthetic oligonucleotide
uuagagaagagugaucugg

SEQ ID NO: 20564 - RNA, 19 nt, Artificial Sequence
  Synthetic oligonucleotide
uguggggcaggugguggcc

SEQ ID NO: 20565 - RNA, 19 nt, Artificial Sequence
  Synthetic oligonucleotide
gggcaggugguggccucaa

SEQ ID NO: 20566 - RNA, 19 nt, Artificial Sequence
  Synthetic oligonucleotide
ggcaggugguggccucaac

SEQ ID NO: 20567 - RNA, 19 nt, Artificial Sequence
  Synthetic oligonucleotide
gcaggugguggccucaaca

SEQ ID NO: 20568 - RNA, 19 nt, Artificial Sequence
  Synthetic oligonucleotide
caggugguggccucaacaa

SEQ ID NO: 20569 - RNA, 19 nt, Artificial Sequence
  Synthetic oligonucleotide
aggugguggccucaacaau

SEQ ID NO: 20570 - RNA, 19 nt, Artificial Sequence
  Synthetic oligonucleotide
ggugguggccucaacaaug

SEQ ID NO: 20571 - RNA, 19 nt, Artificial Sequence
  Synthetic oligonucleotide
guguuccaccuagcuggac

SEQ ID NO: 20572 - RNA, 19 nt, Artificial Sequence
  Synthetic oligonucleotide
uguuccaccuagcuggacu

SEQ ID NO: 20573 - RNA, 19 nt, Artificial Sequence
  Synthetic oligonucleotide
guuccaccuagcuggacuu

SEQ ID NO: 20574 - RNA, 19 nt, Artificial Sequence
  Synthetic oligonucleotide
uuccaccuagcuggacuua

SEQ ID NO: 20575 - RNA, 19 nt, Artificial Sequence
  Synthetic oligonucleotide
uccaccuagcuggacuuac

SEQ ID NO: 20576 - RNA, 19 nt, Artificial Sequence
  Synthetic oligonucleotide
ccaccuagcuggacuuacc

SEQ ID NO: 20577 - RNA, 19 nt, Artificial Sequence
  Synthetic oligonucleotide
caccuagcuggacuuaccu

SEQ ID NO: 20578 - RNA, 19 nt, Artificial Sequence
  Synthetic oligonucleotide
accuagcuggacuuaccuu

SEQ ID NO: 20579 - RNA, 19 nt, Artificial Sequence
  Synthetic oligonucleotide
ccuagcuggacuuaccuuc

SEQ ID NO: 20580 - RNA, 19 nt, Artificial Sequence
  Synthetic oligonucleotide
cuagcuggacuuaccuucc

SEQ ID NO: 20581 - RNA, 19 nt, Artificial Sequence
  Synthetic oligonucleotide
uagcuggacuuaccuuccu

SEQ ID NO: 20582 - RNA, 19 nt, Artificial Sequence
  Synthetic oligonucleotide
agcuggacuuaccuuccuc

SEQ ID NO: 20583 - RNA, 19 nt, Artificial Sequence
  Synthetic oligonucleotide
gcuggacuuaccuuccuca

SEQ ID NO: 20584 - RNA, 19 nt, Artificial Sequence
  Synthetic oligonucleotide
cuggacuuaccuuccucac

SEQ ID NO: 20585 - RNA, 19 nt, Artificial Sequence
  Synthetic oligonucleotide
uggacuuaccuuccucacu

SEQ ID NO: 20586 - RNA, 19 nt, Artificial Sequence
  Synthetic oligonucleotide
ggacuuaccuuccucacua

SEQ ID NO: 20587 - RNA, 19 nt, Artificial Sequence
  Synthetic oligonucleotide
gacuuaccuuccucacuaa

SEQ ID NO: 20588 - RNA, 19 nt, Artificial Sequence
  Synthetic oligonucleotide
acuuaccuuccucacuaau

SEQ ID NO: 20589 - RNA, 19 nt, Artificial Sequence
  Synthetic oligonucleotide
cuuaccuuccucacuaaug

SEQ ID NO: 20590 - RNA, 19 nt, Artificial Sequence
  Synthetic oligonucleotide
uuaccuuccucacuaaugc

SEQ ID NO: 20591 - RNA, 19 nt, Artificial Sequence
  Synthetic oligonucleotide
uaccuuccucacuaaugca

SEQ ID NO: 20592 - RNA, 19 nt, Artificial Sequence
  Synthetic oligonucleotide
accuuccucacuaaugcaa

SEQ ID NO: 20593 - RNA, 19 nt, Artificial Sequence
  Synthetic oligonucleotide
ccuuccucacuaaugcaaa

SEQ ID NO: 20594 - RNA, 19 nt, Artificial Sequence
  Synthetic oligonucleotide
cuuccucacuaaugcaaau

SEQ ID NO: 20595 - RNA, 19 nt, Artificial Sequence
  Synthetic oligonucleotide
uuccucacuaaugcaaaug

SEQ ID NO: 20596 - RNA, 19 nt, Artificial Sequence
  Synthetic oligonucleotide
uccucacuaaugcaaaugc

SEQ ID NO: 20597 - RNA, 19 nt, Artificial Sequence
  Synthetic oligonucleotide
ccucacuaaugcaaaugca

SEQ ID NO: 20598 - RNA, 19 nt, Artificial Sequence
  Synthetic oligonucleotide
cucacuaaugcaaaugcag

SEQ ID NO: 20599 - RNA, 19 nt, Artificial Sequence
  Synthetic oligonucleotide
ucacuaaugcaaaugcaga

SEQ ID NO: 20600 - RNA, 19 nt, Artificial Sequence
  Synthetic oligonucleotide
cacuaaugcaaaugcagau

SEQ ID NO: 20601 - RNA, 19 nt, Artificial Sequence
  Synthetic oligonucleotide
acuaaugcaaaugcagaug

SEQ ID NO: 20602 - RNA, 19 nt, Artificial Sequence
  Synthetic oligonucleotide
cuaaugcaaaugcagauga

SEQ ID NO: 20603 - RNA, 19 nt, Artificial Sequence
  Synthetic oligonucleotide
uaaugcaaaugcagaugac

SEQ ID NO: 20604 - RNA, 19 nt, Artificial Sequence
  Synthetic oligonucleotide
aaugcaaaugcagaugacu

SEQ ID NO: 20605 - RNA, 19 nt, Artificial Sequence
  Synthetic oligonucleotide
augcaaaugcagaugacuc

SEQ ID NO: 20606 - RNA, 19 nt, Artificial Sequence
  Synthetic oligonucleotide
ugcaaaugcagaugacucc

SEQ ID NO: 20607 - RNA, 19 nt, Artificial Sequence
  Synthetic oligonucleotide
gcaaaugcagaugacuccc

SEQ ID NO: 20608 - RNA, 19 nt, Artificial Sequence
  Synthetic oligonucleotide
caaaugcagaugacuccca

SEQ ID NO: 20609 - RNA, 19 nt, Artificial Sequence
  Synthetic oligonucleotide
aaaugcagaugacucccaa

SEQ ID NO: 20610 - RNA, 19 nt, Artificial Sequence
  Synthetic oligonucleotide
aaugcagaugacucccaag

SEQ ID NO: 20611 - RNA, 19 nt, Artificial Sequence
  Synthetic oligonucleotide
augcagaugacucccaaga

SEQ ID NO: 20612 - RNA, 19 nt, Artificial Sequence
  Synthetic oligonucleotide
ugcagaugacucccaagaa

SEQ ID NO: 20613 - RNA, 19 nt, Artificial Sequence
  Synthetic oligonucleotide
gcagaugacucccaagaaa

SEQ ID NO: 20614 - RNA, 19 nt, Artificial Sequence
  Synthetic oligonucleotide
cagaugacucccaagaaaa

SEQ ID NO: 20615 - RNA, 19 nt, Artificial Sequence
  Synthetic oligonucleotide
agaugacucccaagaaaau

SEQ ID NO: 20616 - RNA, 19 nt, Artificial Sequence
  Synthetic oligonucleotide
gaugacucccaagaaaaug

SEQ ID NO: 20617 - RNA, 19 nt, Artificial Sequence
  Synthetic oligonucleotide
augacucccaagaaaauga

SEQ ID NO: 20618 - RNA, 19 nt, Artificial Sequence
  Synthetic oligonucleotide
ugacucccaagaaaaugau

SEQ ID NO: 20619 - RNA, 19 nt, Artificial Sequence
  Synthetic oligonucleotide
gacucccaagaaaaugaug

SEQ ID NO: 20620 - RNA, 19 nt, Artificial Sequence
  Synthetic oligonucleotide
acucccaagaaaaugauga

SEQ ID NO: 20621 - RNA, 19 nt, Artificial Sequence
  Synthetic oligonucleotide
cucccaagaaaaugaugaa

SEQ ID NO: 20622 - RNA, 19 nt, Artificial Sequence
  Synthetic oligonucleotide
ucccaagaaaaugaugaac

SEQ ID NO: 20623 - RNA, 19 nt, Artificial Sequence
  Synthetic oligonucleotide
cccaagaaaaugaugaacc

SEQ ID NO: 20624 - RNA, 19 nt, Artificial Sequence
  Synthetic oligonucleotide
ccaagaaaaugaugaaccu

SEQ ID NO: 20625 - RNA, 19 nt, Artificial Sequence
  Synthetic oligonucleotide
aagaaaaugaugaaccuug

SEQ ID NO: 20626 - RNA, 19 nt, Artificial Sequence
  Synthetic oligonucleotide
agaaaaugaugaaccuugu

SEQ ID NO: 20627 - RNA, 19 nt, Artificial Sequence
  Synthetic oligonucleotide
gaaaaugaugaaccuugua

SEQ ID NO: 20628 - RNA, 19 nt, Artificial Sequence
  Synthetic oligonucleotide
aaaaugaugaaccuuguaa

SEQ ID NO: 20629 - RNA, 19 nt, Artificial Sequence
  Synthetic oligonucleotide
aaugaugaaccuuguaaag

SEQ ID NO: 20630 - RNA, 19 nt, Artificial Sequence
  Synthetic oligonucleotide
gaugaaccuuguaaagaaa

SEQ ID NO: 20631 - RNA, 19 nt, Artificial Sequence
  Synthetic oligonucleotide
aaagaagauagaagaaaua

SEQ ID NO: 20632 - RNA, 19 nt, Artificial Sequence
  Synthetic oligonucleotide
aagaagauagaagaaauag

SEQ ID NO: 20633 - RNA, 19 nt, Artificial Sequence
  Synthetic oligonucleotide
agaagauagaagaaauagc

SEQ ID NO: 20634 - RNA, 19 nt, Artificial Sequence
  Synthetic oligonucleotide
gaagauagaagaaauagcu

SEQ ID NO: 20635 - RNA, 19 nt, Artificial Sequence
  Synthetic oligonucleotide
aagauagaagaaauagcug

SEQ ID NO: 20636 - RNA, 19 nt, Artificial Sequence
  Synthetic oligonucleotide
agauagaagaaauagcugc

SEQ ID NO: 20637 - RNA, 19 nt, Artificial Sequence
  Synthetic oligonucleotide
gauagaagaaauagcugcu

SEQ ID NO: 20638 - RNA, 19 nt, Artificial Sequence
  Synthetic oligonucleotide
auagaagaaauagcugcua

SEQ ID NO: 20639 - RNA, 19 nt, Artificial Sequence
  Synthetic oligonucleotide
uagaagaaauagcugcuaa

SEQ ID NO: 20640 - RNA, 19 nt, Artificial Sequence
  Synthetic oligonucleotide
agaagaaauagcugcuaaa

SEQ ID NO: 20641 - RNA, 19 nt, Artificial Sequence
  Synthetic oligonucleotide
gaagaaauagcugcuaaau

SEQ ID NO: 20642 - RNA, 19 nt, Artificial Sequence
  Synthetic oligonucleotide
aagaaauagcugcuaaaua

SEQ ID NO: 20643 - RNA, 19 nt, Artificial Sequence
  Synthetic oligonucleotide
agaaauagcugcuaaauau

SEQ ID NO: 20644 - RNA, 19 nt, Artificial Sequence
  Synthetic oligonucleotide
gaaauagcugcuaaauaua

SEQ ID NO: 20645 - RNA, 19 nt, Artificial Sequence
  Synthetic oligonucleotide
aaauagcugcuaaauauaa

SEQ ID NO: 20646 - RNA, 19 nt, Artificial Sequence
  Synthetic oligonucleotide
aauagcugcuaaauauaaa

SEQ ID NO: 20647 - RNA, 19 nt, Artificial Sequence
  Synthetic oligonucleotide
auagcugcuaaauauaaac

SEQ ID NO: 20648 - RNA, 19 nt, Artificial Sequence
  Synthetic oligonucleotide
uagcugcuaaauauaaaca

SEQ ID NO: 20649 - RNA, 19 nt, Artificial Sequence
  Synthetic oligonucleotide
aguagugaagaaauguugu

SEQ ID NO: 20650 - RNA, 19 nt, Artificial Sequence
  Synthetic oligonucleotide
guagugaagaaauguuguu

SEQ ID NO: 20651 - RNA, 19 nt, Artificial Sequence
  Synthetic oligonucleotide
uagugaagaaauguuguua

SEQ ID NO: 20652 - RNA, 19 nt, Artificial Sequence
  Synthetic oligonucleotide
agugaagaaauguuguuac

SEQ ID NO: 20653 - RNA, 19 nt, Artificial Sequence
  Synthetic oligonucleotide
gugaagaaauguuguuacg

SEQ ID NO: 20654 - RNA, 19 nt, Artificial Sequence
  Synthetic oligonucleotide
ugaagaaauguuguuacga

SEQ ID NO: 20655 - RNA, 19 nt, Artificial Sequence
  Synthetic oligonucleotide
gaagaaauguuguuacgau

SEQ ID NO: 20656 - RNA, 19 nt, Artificial Sequence
  Synthetic oligonucleotide
aagaaauguuguuacgaug

SEQ ID NO: 20657 - RNA, 19 nt, Artificial Sequence
  Synthetic oligonucleotide
agaaauguuguuacgaugg

SEQ ID NO: 20658 - RNA, 19 nt, Artificial Sequence
  Synthetic oligonucleotide
uaaugaugaaaccugugag

SEQ ID NO: 20659 - RNA, 19 nt, Artificial Sequence
  Synthetic oligonucleotide
aaugaugaaaccugugagc

SEQ ID NO: 20660 - RNA, 19 nt, Artificial Sequence
  Synthetic oligonucleotide
augaugaaaccugugagca

SEQ ID NO: 20661 - RNA, 19 nt, Artificial Sequence
  Synthetic oligonucleotide
ugaugaaaccugugagcag

SEQ ID NO: 20662 - RNA, 19 nt, Artificial Sequence
  Synthetic oligonucleotide
gaugaaaccugugagcagc

SEQ ID NO: 20663 - RNA, 19 nt, Artificial Sequence
  Synthetic oligonucleotide
augaaaccugugagcagcg

SEQ ID NO: 20664 - RNA, 19 nt, Artificial Sequence
  Synthetic oligonucleotide
ugaaaccugugagcagcga

SEQ ID NO: 20665 - RNA, 19 nt, Artificial Sequence
  Synthetic oligonucleotide
aaccugugagcagcgagcu

SEQ ID NO: 20666 - RNA, 19 nt, Artificial Sequence
  Synthetic oligonucleotide
accugugagcagcgagcug

SEQ ID NO: 20667 - RNA, 19 nt, Artificial Sequence
  Synthetic oligonucleotide
ccugugagcagcgagcugc

SEQ ID NO: 20668 - RNA, 19 nt, Artificial Sequence
  Synthetic oligonucleotide
cugugagcagcgagcugca

SEQ ID NO: 20669 - RNA, 19 nt, Artificial Sequence
  Synthetic oligonucleotide
ugugagcagcgagcugcac

SEQ ID NO: 20670 - RNA, 19 nt, Artificial Sequence
  Synthetic oligonucleotide
gugagcagcgagcugcacg

SEQ ID NO: 20671 - RNA, 19 nt, Artificial Sequence
  Synthetic oligonucleotide
ugagcagcgagcugcacgg

SEQ ID NO: 20672 - RNA, 19 nt, Artificial Sequence
  Synthetic oligonucleotide
gagcagcgagcugcacgga

SEQ ID NO: 20673 - RNA, 19 nt, Artificial Sequence
  Synthetic oligonucleotide
agcagcgagcugcacggau

SEQ ID NO: 20674 - RNA, 19 nt, Artificial Sequence
  Synthetic oligonucleotide
gcagcgagcugcacggauu

SEQ ID NO: 20675 - RNA, 19 nt, Artificial Sequence
  Synthetic oligonucleotide
cagcgagcugcacggauua

SEQ ID NO: 20676 - RNA, 19 nt, Artificial Sequence
  Synthetic oligonucleotide
gugucgucgcaagccagcu

SEQ ID NO: 20677 - RNA, 19 nt, Artificial Sequence
  Synthetic oligonucleotide
ugucgucgcaagccagcuc

SEQ ID NO: 20678 - RNA, 19 nt, Artificial Sequence
  Synthetic oligonucleotide
gucgucgcaagccagcucc

SEQ ID NO: 20679 - RNA, 19 nt, Artificial Sequence
  Synthetic oligonucleotide
ucgucgcaagccagcuccg

SEQ ID NO: 20680 - RNA, 19 nt, Artificial Sequence
  Synthetic oligonucleotide
cgucgcaagccagcuccgu

SEQ ID NO: 20681 - RNA, 19 nt, Artificial Sequence
  Synthetic oligonucleotide
gucgcaagccagcuccgug

SEQ ID NO: 20682 - RNA, 19 nt, Artificial Sequence
  Synthetic oligonucleotide
ucgcaagccagcuccgugc

SEQ ID NO: 20683 - RNA, 19 nt, Artificial Sequence
  Synthetic oligonucleotide
cgcaagccagcuccgugcu

SEQ ID NO: 20684 - RNA, 19 nt, Artificial Sequence
  Synthetic oligonucleotide
gcaagccagcuccgugcua

SEQ ID NO: 20685 - RNA, 19 nt, Artificial Sequence
  Synthetic oligonucleotide
caagccagcuccgugcuaa

SEQ ID NO: 20686 - RNA, 19 nt, Artificial Sequence
  Synthetic oligonucleotide
cacaugaagacccuguuac

SEQ ID NO: 20687 - RNA, 19 nt, Artificial Sequence
  Synthetic oligonucleotide
acaugaagacccuguuacc

SEQ ID NO: 20688 - RNA, 19 nt, Artificial Sequence
  Synthetic oligonucleotide
caugaagacccuguuacca

SEQ ID NO: 20689 - RNA, 19 nt, Artificial Sequence
  Synthetic oligonucleotide
ugaagacccuguuaccagu

SEQ ID NO: 20690 - RNA, 19 nt, Artificial Sequence
  Synthetic oligonucleotide
gaagacccuguuaccagua

SEQ ID NO: 20691 - RNA, 19 nt, Artificial Sequence
  Synthetic oligonucleotide
aagacccuguuaccaguaa

SEQ ID NO: 20692 - RNA, 19 nt, Artificial Sequence
  Synthetic oligonucleotide
agacccuguuaccaguaag

SEQ ID NO: 20693 - RNA, 19 nt, Artificial Sequence
  Synthetic oligonucleotide
gacccuguuaccaguaagc

SEQ ID NO: 20694 - RNA, 19 nt, Artificial Sequence
  Synthetic oligonucleotide
acccuguuaccaguaagca

SEQ ID NO: 20695 - RNA, 19 nt, Artificial Sequence
  Synthetic oligonucleotide
cccuguuaccaguaagcaa

SEQ ID NO: 20696 - RNA, 19 nt, Artificial Sequence
  Synthetic oligonucleotide
ccuguuaccaguaagcaag

SEQ ID NO: 20697 - RNA, 19 nt, Artificial Sequence
  Synthetic oligonucleotide
cuguuaccaguaagcaagc

SEQ ID NO: 20698 - RNA, 19 nt, Artificial Sequence
  Synthetic oligonucleotide
uguuaccaguaagcaagcc

SEQ ID NO: 20699 - RNA, 19 nt, Artificial Sequence
  Synthetic oligonucleotide
guuaccaguaagcaagcca

SEQ ID NO: 20700 - RNA, 19 nt, Artificial Sequence
  Synthetic oligonucleotide
uuaccaguaagcaagccag

SEQ ID NO: 20701 - RNA, 19 nt, Artificial Sequence
  Synthetic oligonucleotide
uaccaguaagcaagccaga

SEQ ID NO: 20702 - RNA, 19 nt, Artificial Sequence
  Synthetic oligonucleotide
accaguaagcaagccagaa

SEQ ID NO: 20703 - RNA, 19 nt, Artificial Sequence
  Synthetic oligonucleotide
ccaguaagcaagccagaaa

SEQ ID NO: 20704 - RNA, 19 nt, Artificial Sequence
  Synthetic oligonucleotide
caguaagcaagccagaaau

SEQ ID NO: 20705 - RNA, 19 nt, Artificial Sequence
  Synthetic oligonucleotide
aguaagcaagccagaaauu

SEQ ID NO: 20706 - RNA, 19 nt, Artificial Sequence
  Synthetic oligonucleotide
guaagcaagccagaaauuc

SEQ ID NO: 20707 - RNA, 19 nt, Artificial Sequence
  Synthetic oligonucleotide
uaagcaagccagaaauucg

SEQ ID NO: 20708 - RNA, 19 nt, Artificial Sequence
  Synthetic oligonucleotide
aagcaagccagaaauucgg

SEQ ID NO: 20709 - RNA, 19 nt, Artificial Sequence
  Synthetic oligonucleotide
gcaagccagaaauucggag

SEQ ID NO: 20710 - RNA, 19 nt, Artificial Sequence
  Synthetic oligonucleotide
caagccagaaauucggagu

SEQ ID NO: 20711 - RNA, 19 nt, Artificial Sequence
  Synthetic oligonucleotide
aagccagaaauucggaguu

SEQ ID NO: 20712 - RNA, 19 nt, Artificial Sequence
  Synthetic oligonucleotide
agccagaaauucggaguua

SEQ ID NO: 20713 - RNA, 19 nt, Artificial Sequence
  Synthetic oligonucleotide
gccagaaauucggaguuau

SEQ ID NO: 20714 - RNA, 19 nt, Artificial Sequence
  Synthetic oligonucleotide
ccagaaauucggaguuauu

SEQ ID NO: 20715 - RNA, 19 nt, Artificial Sequence
  Synthetic oligonucleotide
cagaaauucggaguuauuu

SEQ ID NO: 20716 - RNA, 19 nt, Artificial Sequence
  Synthetic oligonucleotide
agaaauucggaguuauuuu

SEQ ID NO: 20717 - RNA, 19 nt, Artificial Sequence
  Synthetic oligonucleotide
gaaauucggaguuauuuuc

SEQ ID NO: 20718 - RNA, 19 nt, Artificial Sequence
  Synthetic oligonucleotide
aaauucggaguuauuuucc

SEQ ID NO: 20719 - RNA, 19 nt, Artificial Sequence
  Synthetic oligonucleotide
aauucggaguuauuuucca

SEQ ID NO: 20720 - RNA, 19 nt, Artificial Sequence
  Synthetic oligonucleotide
auucggaguuauuuuccag

SEQ ID NO: 20721 - RNA, 19 nt, Artificial Sequence
  Synthetic oligonucleotide
uucggaguuauuuuccaga

SEQ ID NO: 20722 - RNA, 19 nt, Artificial Sequence
  Synthetic oligonucleotide
ucggaguuauuuuccagaa

SEQ ID NO: 20723 - RNA, 19 nt, Artificial Sequence
  Synthetic oligonucleotide
cggaguuauuuuccagaaa

SEQ ID NO: 20724 - RNA, 19 nt, Artificial Sequence
  Synthetic oligonucleotide
ggaguuauuuuccagaaag

SEQ ID NO: 20725 - RNA, 19 nt, Artificial Sequence
  Synthetic oligonucleotide
gaguuauuuuccagaaagc

SEQ ID NO: 20726 - RNA, 19 nt, Artificial Sequence
  Synthetic oligonucleotide
aguuauuuuccagaaagcu

SEQ ID NO: 20727 - RNA, 19 nt, Artificial Sequence
  Synthetic oligonucleotide
guuauuuuccagaaagcug

SEQ ID NO: 20728 - RNA, 19 nt, Artificial Sequence
  Synthetic oligonucleotide
uuauuuuccagaaagcugg

SEQ ID NO: 20729 - RNA, 19 nt, Artificial Sequence
  Synthetic oligonucleotide
ugugggaaguucaucuugu

SEQ ID NO: 20730 - RNA, 19 nt, Artificial Sequence
  Synthetic oligonucleotide
gugggaaguucaucuuguu

SEQ ID NO: 20731 - RNA, 19 nt, Artificial Sequence
  Synthetic oligonucleotide
ugggaaguucaucuuguuc

SEQ ID NO: 20732 - RNA, 19 nt, Artificial Sequence
  Synthetic oligonucleotide
gggaaguucaucuuguucc

SEQ ID NO: 20733 - RNA, 19 nt, Artificial Sequence
  Synthetic oligonucleotide
ggaaguucaucuuguuccc

SEQ ID NO: 20734 - RNA, 19 nt, Artificial Sequence
  Synthetic oligonucleotide
gaaguucaucuuguuccca

SEQ ID NO: 20735 - RNA, 19 nt, Artificial Sequence
  Synthetic oligonucleotide
aaguucaucuuguucccag

SEQ ID NO: 20736 - RNA, 19 nt, Artificial Sequence
  Synthetic oligonucleotide
aguucaucuuguucccaga

SEQ ID NO: 20737 - RNA, 19 nt, Artificial Sequence
  Synthetic oligonucleotide
guucaucuuguucccagaa

SEQ ID NO: 20738 - RNA, 19 nt, Artificial Sequence
  Synthetic oligonucleotide
uucaucuuguucccagaag

SEQ ID NO: 20739 - RNA, 19 nt, Artificial Sequence
  Synthetic oligonucleotide
ucaucuuguucccagaaga

SEQ ID NO: 20740 - RNA, 19 nt, Artificial Sequence
  Synthetic oligonucleotide
caucuuguucccagaagaa

SEQ ID NO: 20741 - RNA, 19 nt, Artificial Sequence
  Synthetic oligonucleotide
aucuuguucccagaagaaa

SEQ ID NO: 20742 - RNA, 19 nt, Artificial Sequence
  Synthetic oligonucleotide
ucuuguucccagaagaaaa

SEQ ID NO: 20743 - RNA, 19 nt, Artificial Sequence
  Synthetic oligonucleotide
cuuguucccagaagaaaac

SEQ ID NO: 20744 - RNA, 19 nt, Artificial Sequence
  Synthetic oligonucleotide
uuguucccagaagaaaaca

SEQ ID NO: 20745 - RNA, 19 nt, Artificial Sequence
  Synthetic oligonucleotide
uguucccagaagaaaacag

SEQ ID NO: 20746 - RNA, 19 nt, Artificial Sequence
  Synthetic oligonucleotide
guucccagaagaaaacagu

SEQ ID NO: 20747 - RNA, 19 nt, Artificial Sequence
  Synthetic oligonucleotide
uucccagaagaaaacaguu

SEQ ID NO: 20748 - RNA, 19 nt, Artificial Sequence
  Synthetic oligonucleotide
ucccagaagaaaacaguug

SEQ ID NO: 20749 - RNA, 19 nt, Artificial Sequence
  Synthetic oligonucleotide
cccagaagaaaacaguugc

SEQ ID NO: 20750 - RNA, 19 nt, Artificial Sequence
  Synthetic oligonucleotide
ccagaagaaaacaguugca

SEQ ID NO: 20751 - RNA, 19 nt, Artificial Sequence
  Synthetic oligonucleotide
cagaagaaaacaguugcag

SEQ ID NO: 20752 - RNA, 19 nt, Artificial Sequence
  Synthetic oligonucleotide
agaagaaaacaguugcagu

SEQ ID NO: 20753 - RNA, 19 nt, Artificial Sequence
  Synthetic oligonucleotide
gaagaaaacaguugcaguu

SEQ ID NO: 20754 - RNA, 19 nt, Artificial Sequence
  Synthetic oligonucleotide
aagaaaacaguugcaguuu

SEQ ID NO: 20755 - RNA, 19 nt, Artificial Sequence
  Synthetic oligonucleotide
agaaaacaguugcaguuug

SEQ ID NO: 20756 - RNA, 19 nt, Artificial Sequence
  Synthetic oligonucleotide
gaaaacaguugcaguuugc

SEQ ID NO: 20757 - RNA, 19 nt, Artificial Sequence
  Synthetic oligonucleotide
aaaacaguugcaguuugcc

SEQ ID NO: 20758 - RNA, 19 nt, Artificial Sequence
  Synthetic oligonucleotide
aaacaguugcaguuugccc

SEQ ID NO: 20759 - RNA, 19 nt, Artificial Sequence
  Synthetic oligonucleotide
aacaguugcaguuugcccu

SEQ ID NO: 20760 - RNA, 19 nt, Artificial Sequence
  Synthetic oligonucleotide
acaguugcaguuugcccua

SEQ ID NO: 20761 - RNA, 19 nt, Artificial Sequence
  Synthetic oligonucleotide
caguugcaguuugcccuac

SEQ ID NO: 20762 - RNA, 19 nt, Artificial Sequence
  Synthetic oligonucleotide
aguugcaguuugcccuacc

SEQ ID NO: 20763 - RNA, 19 nt, Artificial Sequence
  Synthetic oligonucleotide
guugcaguuugcccuaccu

SEQ ID NO: 20764 - RNA, 19 nt, Artificial Sequence
  Synthetic oligonucleotide
uugcaguuugcccuaccug

SEQ ID NO: 20765 - RNA, 19 nt, Artificial Sequence
  Synthetic oligonucleotide
ugcaguuugcccuaccuga

SEQ ID NO: 20766 - RNA, 19 nt, Artificial Sequence
  Synthetic oligonucleotide
gcaguuugcccuaccugau

SEQ ID NO: 20767 - RNA, 19 nt, Artificial Sequence
  Synthetic oligonucleotide
caguuugcccuaccugauu

SEQ ID NO: 20768 - RNA, 19 nt, Artificial Sequence
  Synthetic oligonucleotide
aaggcaaagguguucaaag

SEQ ID NO: 20769 - RNA, 19 nt, Artificial Sequence
  Synthetic oligonucleotide
aggcaaagguguucaaaga

SEQ ID NO: 20770 - RNA, 19 nt, Artificial Sequence
  Synthetic oligonucleotide
ggcaaagguguucaaagau

SEQ ID NO: 20771 - RNA, 19 nt, Artificial Sequence
  Synthetic oligonucleotide
gcaaagguguucaaagaug

SEQ ID NO: 20772 - RNA, 19 nt, Artificial Sequence
  Synthetic oligonucleotide
caaagguguucaaagaugu

SEQ ID NO: 20773 - RNA, 19 nt, Artificial Sequence
  Synthetic oligonucleotide
aaagguguucaaagauguc

SEQ ID NO: 20774 - RNA, 19 nt, Artificial Sequence
  Synthetic oligonucleotide
aagguguucaaagaugucu

SEQ ID NO: 20775 - RNA, 19 nt, Artificial Sequence
  Synthetic oligonucleotide
agguguucaaagaugucuu

SEQ ID NO: 20776 - RNA, 19 nt, Artificial Sequence
  Synthetic oligonucleotide
gguguucaaagaugucuuc

SEQ ID NO: 20777 - RNA, 19 nt, Artificial Sequence
  Synthetic oligonucleotide
guguucaaagaugucuucc

SEQ ID NO: 20778 - RNA, 19 nt, Artificial Sequence
  Synthetic oligonucleotide
uguucaaagaugucuuccu

SEQ ID NO: 20779 - RNA, 19 nt, Artificial Sequence
  Synthetic oligonucleotide
guucaaagaugucuuccug

SEQ ID NO: 20780 - RNA, 19 nt, Artificial Sequence
  Synthetic oligonucleotide
uucaaagaugucuuccugg

SEQ ID NO: 20781 - RNA, 19 nt, Artificial Sequence
  Synthetic oligonucleotide
ucaaagaugucuuccugga

SEQ ID NO: 20782 - RNA, 19 nt, Artificial Sequence
  Synthetic oligonucleotide
caaagaugucuuccuggaa

SEQ ID NO: 20783 - RNA, 19 nt, Artificial Sequence
  Synthetic oligonucleotide
aaagaugucuuccuggaaa

SEQ ID NO: 20784 - RNA, 19 nt, Artificial Sequence
  Synthetic oligonucleotide
agaugucuuccuggaaaug

SEQ ID NO: 20785 - RNA, 19 nt, Artificial Sequence
  Synthetic oligonucleotide
gaugucuuccuggaaauga

SEQ ID NO: 20786 - RNA, 19 nt, Artificial Sequence
  Synthetic oligonucleotide
augucuuccuggaaaugaa

SEQ ID NO: 20787 - RNA, 19 nt, Artificial Sequence
  Synthetic oligonucleotide
ugucuuccuggaaaugaau

SEQ ID NO: 20788 - RNA, 19 nt, Artificial Sequence
  Synthetic oligonucleotide
gucuuccuggaaaugaaua

SEQ ID NO: 20789 - RNA, 19 nt, Artificial Sequence
  Synthetic oligonucleotide
ucuuccuggaaaugaauau

SEQ ID NO: 20790 - RNA, 19 nt, Artificial Sequence
  Synthetic oligonucleotide
cuuccuggaaaugaauaua

SEQ ID NO: 20791 - RNA, 19 nt, Artificial Sequence
  Synthetic oligonucleotide
uuccuggaaaugaauauac

SEQ ID NO: 20792 - RNA, 19 nt, Artificial Sequence
  Synthetic oligonucleotide
aauauaccauauucuguug

SEQ ID NO: 20793 - RNA, 19 nt, Artificial Sequence
  Synthetic oligonucleotide
auauaccauauucuguugu

SEQ ID NO: 20794 - RNA, 19 nt, Artificial Sequence
  Synthetic oligonucleotide
uauaccauauucuguugua

SEQ ID NO: 20795 - RNA, 19 nt, Artificial Sequence
  Synthetic oligonucleotide
auaccauauucuguuguac

SEQ ID NO: 20796 - RNA, 19 nt, Artificial Sequence
  Synthetic oligonucleotide
uaccauauucuguuguacg

SEQ ID NO: 20797 - RNA, 19 nt, Artificial Sequence
  Synthetic oligonucleotide
accauauucuguuguacga

SEQ ID NO: 20798 - RNA, 19 nt, Artificial Sequence
  Synthetic oligonucleotide
ccauauucuguuguacgag

SEQ ID NO: 20799 - RNA, 19 nt, Artificial Sequence
  Synthetic oligonucleotide
cauauucuguuguacgagg

SEQ ID NO: 20800 - RNA, 19 nt, Artificial Sequence
  Synthetic oligonucleotide
auauucuguuguacgagga

SEQ ID NO: 20801 - RNA, 19 nt, Artificial Sequence
  Synthetic oligonucleotide
uauucuguuguacgaggag

SEQ ID NO: 20802 - RNA, 19 nt, Artificial Sequence
  Synthetic oligonucleotide
auucuguuguacgaggaga

SEQ ID NO: 20803 - RNA, 19 nt, Artificial Sequence
  Synthetic oligonucleotide
uucuguuguacgaggagaa

SEQ ID NO: 20804 - RNA, 19 nt, Artificial Sequence
  Synthetic oligonucleotide
ucuguuguacgaggagaac

SEQ ID NO: 20805 - RNA, 19 nt, Artificial Sequence
  Synthetic oligonucleotide
aggaacuguuuacaacuau

SEQ ID NO: 20806 - RNA, 19 nt, Artificial Sequence
  Synthetic oligonucleotide
ggaacuguuuacaacuaua

SEQ ID NO: 20807 - RNA, 19 nt, Artificial Sequence
  Synthetic oligonucleotide
gaacuguuuacaacuauag

SEQ ID NO: 20808 - RNA, 19 nt, Artificial Sequence
  Synthetic oligonucleotide
aacuguuuacaacuauagg

SEQ ID NO: 20809 - RNA, 19 nt, Artificial Sequence
  Synthetic oligonucleotide
acuguuuacaacuauagga

SEQ ID NO: 20810 - RNA, 19 nt, Artificial Sequence
  Synthetic oligonucleotide
cuguuuacaacuauaggac

SEQ ID NO: 20811 - RNA, 19 nt, Artificial Sequence
  Synthetic oligonucleotide
uguuuacaacuauaggacu

SEQ ID NO: 20812 - RNA, 19 nt, Artificial Sequence
  Synthetic oligonucleotide
guuuacaacuauaggacuu

SEQ ID NO: 20813 - RNA, 19 nt, Artificial Sequence
  Synthetic oligonucleotide
uuuacaacuauaggacuuc

SEQ ID NO: 20814 - RNA, 19 nt, Artificial Sequence
  Synthetic oligonucleotide
uuacaacuauaggacuucu

SEQ ID NO: 20815 - RNA, 19 nt, Artificial Sequence
  Synthetic oligonucleotide
uacaacuauaggacuucug

SEQ ID NO: 20816 - RNA, 19 nt, Artificial Sequence
  Synthetic oligonucleotide
acaacuauaggacuucugg

SEQ ID NO: 20817 - RNA, 19 nt, Artificial Sequence
  Synthetic oligonucleotide
caacuauaggacuucuggg

SEQ ID NO: 20818 - RNA, 19 nt, Artificial Sequence
  Synthetic oligonucleotide
aacuauaggacuucuggga

SEQ ID NO: 20819 - RNA, 19 nt, Artificial Sequence
  Synthetic oligonucleotide
acuauaggacuucugggau

SEQ ID NO: 20820 - RNA, 19 nt, Artificial Sequence
  Synthetic oligonucleotide
cuauaggacuucugggaug

SEQ ID NO: 20821 - RNA, 19 nt, Artificial Sequence
  Synthetic oligonucleotide
uauaggacuucugggaugc

SEQ ID NO: 20822 - RNA, 19 nt, Artificial Sequence
  Synthetic oligonucleotide
auaggacuucugggaugca

SEQ ID NO: 20823 - RNA, 19 nt, Artificial Sequence
  Synthetic oligonucleotide
aaaaugucugcuguggagg

SEQ ID NO: 20824 - RNA, 19 nt, Artificial Sequence
  Synthetic oligonucleotide
aaaugucugcuguggaggg

SEQ ID NO: 20825 - RNA, 19 nt, Artificial Sequence
  Synthetic oligonucleotide
aaugucugcuguggaggga

SEQ ID NO: 20826 - RNA, 19 nt, Artificial Sequence
  Synthetic oligonucleotide
augucugcuguggagggaa

SEQ ID NO: 20827 - RNA, 19 nt, Artificial Sequence
  Synthetic oligonucleotide
ugucugcuguggagggaau

SEQ ID NO: 20828 - RNA, 19 nt, Artificial Sequence
  Synthetic oligonucleotide
gucugcuguggagggaauc

SEQ ID NO: 20829 - RNA, 19 nt, Artificial Sequence
  Synthetic oligonucleotide
ucugcuguggagggaaucu

SEQ ID NO: 20830 - RNA, 19 nt, Artificial Sequence
  Synthetic oligonucleotide
cugcuguggagggaaucug

SEQ ID NO: 20831 - RNA, 19 nt, Artificial Sequence
  Synthetic oligonucleotide
ugcuguggagggaaucugc

SEQ ID NO: 20832 - RNA, 19 nt, Artificial Sequence
  Synthetic oligonucleotide
gcuguggagggaaucugca

SEQ ID NO: 20833 - RNA, 19 nt, Artificial Sequence
  Synthetic oligonucleotide
cuguggagggaaucugcac

SEQ ID NO: 20834 - RNA, 19 nt, Artificial Sequence
  Synthetic oligonucleotide
uguggagggaaucugcacu

SEQ ID NO: 20835 - RNA, 19 nt, Artificial Sequence
  Synthetic oligonucleotide
cggaaagcccagucauuga

SEQ ID NO: 20836 - RNA, 19 nt, Artificial Sequence
  Synthetic oligonucleotide
ggaaagcccagucauugau

SEQ ID NO: 20837 - RNA, 19 nt, Artificial Sequence
  Synthetic oligonucleotide
gaaagcccagucauugauc

SEQ ID NO: 20838 - RNA, 19 nt, Artificial Sequence
  Synthetic oligonucleotide
aaagcccagucauugauca

SEQ ID NO: 20839 - RNA, 19 nt, Artificial Sequence
  Synthetic oligonucleotide
aagcccagucauugaucau

SEQ ID NO: 20840 - RNA, 19 nt, Artificial Sequence
  Synthetic oligonucleotide
agcccagucauugaucauc

SEQ ID NO: 20841 - RNA, 19 nt, Artificial Sequence
  Synthetic oligonucleotide
gcccagucauugaucauca

SEQ ID NO: 20842 - RNA, 19 nt, Artificial Sequence
  Synthetic oligonucleotide
cccagucauugaucaucag

SEQ ID NO: 20843 - RNA, 19 nt, Artificial Sequence
  Synthetic oligonucleotide
ccagucauugaucaucagg

SEQ ID NO: 20844 - RNA, 19 nt, Artificial Sequence
  Synthetic oligonucleotide
cagucauugaucaucaggg

SEQ ID NO: 20845 - RNA, 19 nt, Artificial Sequence
  Synthetic oligonucleotide
agucauugaucaucagggc

SEQ ID NO: 20846 - RNA, 19 nt, Artificial Sequence
  Synthetic oligonucleotide
gucauugaucaucagggca

SEQ ID NO: 20847 - RNA, 19 nt, Artificial Sequence
  Synthetic oligonucleotide
ucauugaucaucagggcac

SEQ ID NO: 20848 - RNA, 19 nt, Artificial Sequence
  Synthetic oligonucleotide
cauugaucaucagggcaca

SEQ ID NO: 20849 - RNA, 19 nt, Artificial Sequence
  Synthetic oligonucleotide
auugaucaucagggcacaa

SEQ ID NO: 20850 - RNA, 19 nt, Artificial Sequence
  Synthetic oligonucleotide
uugaucaucagggcacaaa

SEQ ID NO: 20851 - RNA, 19 nt, Artificial Sequence
  Synthetic oligonucleotide
ugaucaucagggcacaaag

SEQ ID NO: 20852 - RNA, 19 nt, Artificial Sequence
  Synthetic oligonucleotide
gaucaucagggcacaaagu

SEQ ID NO: 20853 - RNA, 19 nt, Artificial Sequence
  Synthetic oligonucleotide
aucaucagggcacaaaguc

SEQ ID NO: 20854 - RNA, 19 nt, Artificial Sequence
  Synthetic oligonucleotide
ucaucagggcacaaagucc

SEQ ID NO: 20855 - RNA, 19 nt, Artificial Sequence
  Synthetic oligonucleotide
caucagggcacaaaguccu

SEQ ID NO: 20856 - RNA, 19 nt, Artificial Sequence
  Synthetic oligonucleotide
aucagggcacaaaguccuc

SEQ ID NO: 20857 - RNA, 19 nt, Artificial Sequence
  Synthetic oligonucleotide
ccagaaaguagagggcucc

SEQ ID NO: 20858 - RNA, 19 nt, Artificial Sequence
  Synthetic oligonucleotide
ucacugugcuuccucugga

SEQ ID NO: 20859 - RNA, 19 nt, Artificial Sequence
  Synthetic oligonucleotide
cacugugcuuccucuggaa

SEQ ID NO: 20860 - RNA, 19 nt, Artificial Sequence
  Synthetic oligonucleotide
acugugcuuccucuggaaa

SEQ ID NO: 20861 - RNA, 19 nt, Artificial Sequence
  Synthetic oligonucleotide
cugugcuuccucuggaaau

SEQ ID NO: 20862 - RNA, 19 nt, Artificial Sequence
  Synthetic oligonucleotide
ugguuuggaaaagaaaucu

SEQ ID NO: 20863 - RNA, 19 nt, Artificial Sequence
  Synthetic oligonucleotide
gguuuggaaaagaaaucuu

SEQ ID NO: 20864 - RNA, 19 nt, Artificial Sequence
  Synthetic oligonucleotide
guuuggaaaagaaaucuua

SEQ ID NO: 20865 - RNA, 19 nt, Artificial Sequence
  Synthetic oligonucleotide
uuuggaaaagaaaucuuag

SEQ ID NO: 20866 - RNA, 19 nt, Artificial Sequence
  Synthetic oligonucleotide
uuggaaaagaaaucuuagu

SEQ ID NO: 20867 - RNA, 19 nt, Artificial Sequence
  Synthetic oligonucleotide
uggaaaagaaaucuuagua

SEQ ID NO: 20868 - RNA, 19 nt, Artificial Sequence
  Synthetic oligonucleotide
ggaaaagaaaucuuaguaa

SEQ ID NO: 20869 - RNA, 19 nt, Artificial Sequence
  Synthetic oligonucleotide
cauuacgaguggugccaga

SEQ ID NO: 20870 - RNA, 19 nt, Artificial Sequence
  Synthetic oligonucleotide
auuacgaguggugccagaa

SEQ ID NO: 20871 - RNA, 19 nt, Artificial Sequence
  Synthetic oligonucleotide
uuacgaguggugccagaag

SEQ ID NO: 20872 - RNA, 19 nt, Artificial Sequence
  Synthetic oligonucleotide
uacgaguggugccagaagg

SEQ ID NO: 20873 - RNA, 19 nt, Artificial Sequence
  Synthetic oligonucleotide
acgaguggugccagaaggu

SEQ ID NO: 20874 - RNA, 19 nt, Artificial Sequence
  Synthetic oligonucleotide
cgaguggugccagaaggug

SEQ ID NO: 20875 - RNA, 19 nt, Artificial Sequence
  Synthetic oligonucleotide
gaguggugccagaaggugu

SEQ ID NO: 20876 - RNA, 19 nt, Artificial Sequence
  Synthetic oligonucleotide
aguggugccagaagguguc

SEQ ID NO: 20877 - RNA, 19 nt, Artificial Sequence
  Synthetic oligonucleotide
guggugccagaagguguca

SEQ ID NO: 20878 - RNA, 19 nt, Artificial Sequence
  Synthetic oligonucleotide
uggugccagaaggugucaa

SEQ ID NO: 20879 - RNA, 19 nt, Artificial Sequence
  Synthetic oligonucleotide
ggugccagaaggugucaaa

SEQ ID NO: 20880 - RNA, 19 nt, Artificial Sequence
  Synthetic oligonucleotide
gugccagaaggugucaaaa

SEQ ID NO: 20881 - RNA, 19 nt, Artificial Sequence
  Synthetic oligonucleotide
ugccagaaggugucaaaag

SEQ ID NO: 20882 - RNA, 19 nt, Artificial Sequence
  Synthetic oligonucleotide
gccagaaggugucaaaagg

SEQ ID NO: 20883 - RNA, 19 nt, Artificial Sequence
  Synthetic oligonucleotide
ccagaaggugucaaaaggg

SEQ ID NO: 20884 - RNA, 19 nt, Artificial Sequence
  Synthetic oligonucleotide
cagaaggugucaaaaggga

SEQ ID NO: 20885 - RNA, 19 nt, Artificial Sequence
  Synthetic oligonucleotide
agaaggugucaaaagggaa

SEQ ID NO: 20886 - RNA, 19 nt, Artificial Sequence
  Synthetic oligonucleotide
gaaggugucaaaagggaaa

SEQ ID NO: 20887 - RNA, 19 nt, Artificial Sequence
  Synthetic oligonucleotide
aaggugucaaaagggaaag

SEQ ID NO: 20888 - RNA, 19 nt, Artificial Sequence
  Synthetic oligonucleotide
aggugucaaaagggaaagc

SEQ ID NO: 20889 - RNA, 19 nt, Artificial Sequence
  Synthetic oligonucleotide
ggugucaaaagggaaagcu

SEQ ID NO: 20890 - RNA, 19 nt, Artificial Sequence
  Synthetic oligonucleotide
gugucaaaagggaaagcua

SEQ ID NO: 20891 - RNA, 19 nt, Artificial Sequence
  Synthetic oligonucleotide
ugucaaaagggaaagcuau

SEQ ID NO: 20892 - RNA, 19 nt, Artificial Sequence
  Synthetic oligonucleotide
gucaaaagggaaagcuauu

SEQ ID NO: 20893 - RNA, 19 nt, Artificial Sequence
  Synthetic oligonucleotide
ucaaaagggaaagcuauuc

SEQ ID NO: 20894 - RNA, 19 nt, Artificial Sequence
  Synthetic oligonucleotide
caaaagggaaagcuauucu

SEQ ID NO: 20895 - RNA, 19 nt, Artificial Sequence
  Synthetic oligonucleotide
aaaagggaaagcuauucug

SEQ ID NO: 20896 - RNA, 19 nt, Artificial Sequence
  Synthetic oligonucleotide
uguuacuuuggauccuagg

SEQ ID NO: 20897 - RNA, 19 nt, Artificial Sequence
  Synthetic oligonucleotide
guuacuuuggauccuaggg

SEQ ID NO: 20898 - RNA, 19 nt, Artificial Sequence
  Synthetic oligonucleotide
uuacuuuggauccuagggg

SEQ ID NO: 20899 - RNA, 19 nt, Artificial Sequence
  Synthetic oligonucleotide
uacuuuggauccuaggggu

SEQ ID NO: 20900 - RNA, 19 nt, Artificial Sequence
  Synthetic oligonucleotide
acuuuggauccuaggggua

SEQ ID NO: 20901 - RNA, 19 nt, Artificial Sequence
  Synthetic oligonucleotide
cuuuggauccuagggguau

SEQ ID NO: 20902 - RNA, 19 nt, Artificial Sequence
  Synthetic oligonucleotide
uuuggauccuagggguauu

SEQ ID NO: 20903 - RNA, 19 nt, Artificial Sequence
  Synthetic oligonucleotide
uuggauccuagggguauuu

SEQ ID NO: 20904 - RNA, 19 nt, Artificial Sequence
  Synthetic oligonucleotide
uggauccuagggguauuua

SEQ ID NO: 20905 - RNA, 19 nt, Artificial Sequence
  Synthetic oligonucleotide
gacgaaaggaguucccaua

SEQ ID NO: 20906 - RNA, 19 nt, Artificial Sequence
  Synthetic oligonucleotide
acgaaaggaguucccauac

SEQ ID NO: 20907 - RNA, 19 nt, Artificial Sequence
  Synthetic oligonucleotide
cgaaaggaguucccauaca

SEQ ID NO: 20908 - RNA, 19 nt, Artificial Sequence
  Synthetic oligonucleotide
gaaaggaguucccauacag

SEQ ID NO: 20909 - RNA, 19 nt, Artificial Sequence
  Synthetic oligonucleotide
aaaggaguucccauacagg

SEQ ID NO: 20910 - RNA, 19 nt, Artificial Sequence
  Synthetic oligonucleotide
aaggaguucccauacagga

SEQ ID NO: 20911 - RNA, 19 nt, Artificial Sequence
  Synthetic oligonucleotide
aggaguucccauacaggau

SEQ ID NO: 20912 - RNA, 19 nt, Artificial Sequence
  Synthetic oligonucleotide
ggaguucccauacaggaua

SEQ ID NO: 20913 - RNA, 19 nt, Artificial Sequence
  Synthetic oligonucleotide
ccuuagauuugguccccaa

SEQ ID NO: 20914 - RNA, 19 nt, Artificial Sequence
  Synthetic oligonucleotide
cuuagauuugguccccaaa

SEQ ID NO: 20915 - RNA, 19 nt, Artificial Sequence
  Synthetic oligonucleotide
uuagauuugguccccaaaa

SEQ ID NO: 20916 - RNA, 19 nt, Artificial Sequence
  Synthetic oligonucleotide
uagauuugguccccaaaac

SEQ ID NO: 20917 - RNA, 19 nt, Artificial Sequence
  Synthetic oligonucleotide
agauuugguccccaaaaca

SEQ ID NO: 20918 - RNA, 19 nt, Artificial Sequence
  Synthetic oligonucleotide
gauuugguccccaaaacag

SEQ ID NO: 20919 - RNA, 19 nt, Artificial Sequence
  Synthetic oligonucleotide
auuugguccccaaaacaga

SEQ ID NO: 20920 - RNA, 19 nt, Artificial Sequence
  Synthetic oligonucleotide
uuugguccccaaaacagaa

SEQ ID NO: 20921 - RNA, 19 nt, Artificial Sequence
  Synthetic oligonucleotide
uugguccccaaaacagaaa

SEQ ID NO: 20922 - RNA, 19 nt, Artificial Sequence
  Synthetic oligonucleotide
ugguccccaaaacagaaau

SEQ ID NO: 20923 - RNA, 19 nt, Artificial Sequence
  Synthetic oligonucleotide
gguccccaaaacagaaauc

SEQ ID NO: 20924 - RNA, 19 nt, Artificial Sequence
  Synthetic oligonucleotide
guccccaaaacagaaauca

SEQ ID NO: 20925 - RNA, 19 nt, Artificial Sequence
  Synthetic oligonucleotide
uccccaaaacagaaaucaa

SEQ ID NO: 20926 - RNA, 19 nt, Artificial Sequence
  Synthetic oligonucleotide
ccccaaaacagaaaucaaa

SEQ ID NO: 20927 - RNA, 19 nt, Artificial Sequence
  Synthetic oligonucleotide
cccaaaacagaaaucaaaa

SEQ ID NO: 20928 - RNA, 19 nt, Artificial Sequence
  Synthetic oligonucleotide
ccaaaacagaaaucaaaag

SEQ ID NO: 20929 - RNA, 19 nt, Artificial Sequence
  Synthetic oligonucleotide
caaaacagaaaucaaaagg

SEQ ID NO: 20930 - RNA, 19 nt, Artificial Sequence
  Synthetic oligonucleotide
aaaacagaaaucaaaagga

SEQ ID NO: 20931 - RNA, 19 nt, Artificial Sequence
  Synthetic oligonucleotide
aaacagaaaucaaaaggau

SEQ ID NO: 20932 - RNA, 19 nt, Artificial Sequence
  Synthetic oligonucleotide
aacagaaaucaaaaggauu

SEQ ID NO: 20933 - RNA, 19 nt, Artificial Sequence
  Synthetic oligonucleotide
agaaaucaaaaggauuuug

SEQ ID NO: 20934 - RNA, 19 nt, Artificial Sequence
  Synthetic oligonucleotide
gaaaucaaaaggauuuuga

SEQ ID NO: 20935 - RNA, 19 nt, Artificial Sequence
  Synthetic oligonucleotide
aaaucaaaaggauuuugag

SEQ ID NO: 20936 - RNA, 19 nt, Artificial Sequence
  Synthetic oligonucleotide
aaucaaaaggauuuugagu

SEQ ID NO: 20937 - RNA, 19 nt, Artificial Sequence
  Synthetic oligonucleotide
ucaaaaggauuuugagugu

SEQ ID NO: 20938 - RNA, 19 nt, Artificial Sequence
  Synthetic oligonucleotide
caaaaggauuuugagugua

SEQ ID NO: 20939 - RNA, 19 nt, Artificial Sequence
  Synthetic oligonucleotide
aaaaggauuuugaguguaa

SEQ ID NO: 20940 - RNA, 19 nt, Artificial Sequence
  Synthetic oligonucleotide
aaaggauuuugaguguaaa

SEQ ID NO: 20941 - RNA, 19 nt, Artificial Sequence
  Synthetic oligonucleotide
aaggauuuugaguguaaaa

SEQ ID NO: 20942 - RNA, 19 nt, Artificial Sequence
  Synthetic oligonucleotide
aggauuuugaguguaaaag

SEQ ID NO: 20943 - RNA, 19 nt, Artificial Sequence
  Synthetic oligonucleotide
ggauuuugaguguaaaagg

SEQ ID NO: 20944 - RNA, 19 nt, Artificial Sequence
  Synthetic oligonucleotide
gauuuugaguguaaaagga

SEQ ID NO: 20945 - RNA, 19 nt, Artificial Sequence
  Synthetic oligonucleotide
auuuugaguguaaaaggac

SEQ ID NO: 20946 - RNA, 19 nt, Artificial Sequence
  Synthetic oligonucleotide
uuuugaguguaaaaggacu

SEQ ID NO: 20947 - RNA, 19 nt, Artificial Sequence
  Synthetic oligonucleotide
uuugaguguaaaaggacug

SEQ ID NO: 20948 - RNA, 19 nt, Artificial Sequence
  Synthetic oligonucleotide
uugaguguaaaaggacugc

SEQ ID NO: 20949 - RNA, 19 nt, Artificial Sequence
  Synthetic oligonucleotide
ugaguguaaaaggacugcu

SEQ ID NO: 20950 - RNA, 19 nt, Artificial Sequence
  Synthetic oligonucleotide
gaguguaaaaggacugcuu

SEQ ID NO: 20951 - RNA, 19 nt, Artificial Sequence
  Synthetic oligonucleotide
aguguaaaaggacugcuug

SEQ ID NO: 20952 - RNA, 19 nt, Artificial Sequence
  Synthetic oligonucleotide
guguaaaaggacugcuugu

SEQ ID NO: 20953 - RNA, 19 nt, Artificial Sequence
  Synthetic oligonucleotide
uguaaaaggacugcuugua

SEQ ID NO: 20954 - RNA, 19 nt, Artificial Sequence
  Synthetic oligonucleotide
guaaaaggacugcuuguag

SEQ ID NO: 20955 - RNA, 19 nt, Artificial Sequence
  Synthetic oligonucleotide
uaaaaggacugcuuguagg

SEQ ID NO: 20956 - RNA, 19 nt, Artificial Sequence
  Synthetic oligonucleotide
aaaaggacugcuuguaggu

SEQ ID NO: 20957 - RNA, 19 nt, Artificial Sequence
  Synthetic oligonucleotide
aaaggacugcuuguaggug

SEQ ID NO: 20958 - RNA, 19 nt, Artificial Sequence
  Synthetic oligonucleotide
aaggacugcuuguagguga

SEQ ID NO: 20959 - RNA, 19 nt, Artificial Sequence
  Synthetic oligonucleotide
aggacugcuuguaggugag

SEQ ID NO: 20960 - RNA, 19 nt, Artificial Sequence
  Synthetic oligonucleotide
ggacugcuuguaggugaga

SEQ ID NO: 20961 - RNA, 19 nt, Artificial Sequence
  Synthetic oligonucleotide
gacugcuuguaggugagau

SEQ ID NO: 20962 - RNA, 19 nt, Artificial Sequence
  Synthetic oligonucleotide
acugcuuguaggugagauc

SEQ ID NO: 20963 - RNA, 19 nt, Artificial Sequence
  Synthetic oligonucleotide
cugcuuguaggugagaucu

SEQ ID NO: 20964 - RNA, 19 nt, Artificial Sequence
  Synthetic oligonucleotide
ugcuuguaggugagaucuu

SEQ ID NO: 20965 - RNA, 19 nt, Artificial Sequence
  Synthetic oligonucleotide
gcuuguaggugagaucuug

SEQ ID NO: 20966 - RNA, 19 nt, Artificial Sequence
  Synthetic oligonucleotide
cuuguaggugagaucuugu

SEQ ID NO: 20967 - RNA, 19 nt, Artificial Sequence
  Synthetic oligonucleotide
uuguaggugagaucuuguc

SEQ ID NO: 20968 - RNA, 19 nt, Artificial Sequence
  Synthetic oligonucleotide
uguaggugagaucuugucu

SEQ ID NO: 20969 - RNA, 19 nt, Artificial Sequence
  Synthetic oligonucleotide
guaggugagaucuugucug

SEQ ID NO: 20970 - RNA, 19 nt, Artificial Sequence
  Synthetic oligonucleotide
uaggugagaucuugucugc

SEQ ID NO: 20971 - RNA, 19 nt, Artificial Sequence
  Synthetic oligonucleotide
aggugagaucuugucugca

SEQ ID NO: 20972 - RNA, 19 nt, Artificial Sequence
  Synthetic oligonucleotide
ggugagaucuugucugcag

SEQ ID NO: 20973 - RNA, 19 nt, Artificial Sequence
  Synthetic oligonucleotide
gugagaucuugucugcagu

SEQ ID NO: 20974 - RNA, 19 nt, Artificial Sequence
  Synthetic oligonucleotide
ugagaucuugucugcaguu

SEQ ID NO: 20975 - RNA, 19 nt, Artificial Sequence
  Synthetic oligonucleotide
gagaucuugucugcaguuc

SEQ ID NO: 20976 - RNA, 19 nt, Artificial Sequence
  Synthetic oligonucleotide
agaucuugucugcaguucu

SEQ ID NO: 20977 - RNA, 19 nt, Artificial Sequence
  Synthetic oligonucleotide
gaucuugucugcaguucua

SEQ ID NO: 20978 - RNA, 19 nt, Artificial Sequence
  Synthetic oligonucleotide
aucuugucugcaguucuaa

SEQ ID NO: 20979 - RNA, 19 nt, Artificial Sequence
  Synthetic oligonucleotide
ucuugucugcaguucuaag

SEQ ID NO: 20980 - RNA, 19 nt, Artificial Sequence
  Synthetic oligonucleotide
caggaaggcaucaauaucc

SEQ ID NO: 20981 - RNA, 19 nt, Artificial Sequence
  Synthetic oligonucleotide
aggaaggcaucaauauccu

SEQ ID NO: 20982 - RNA, 19 nt, Artificial Sequence
  Synthetic oligonucleotide
ggaaggcaucaauauccua

SEQ ID NO: 20983 - RNA, 19 nt, Artificial Sequence
  Synthetic oligonucleotide
gaaggcaucaauauccuaa

SEQ ID NO: 20984 - RNA, 19 nt, Artificial Sequence
  Synthetic oligonucleotide
aaggcaucaauauccuaac

SEQ ID NO: 20985 - RNA, 19 nt, Artificial Sequence
  Synthetic oligonucleotide
aggcaucaauauccuaacc

SEQ ID NO: 20986 - RNA, 19 nt, Artificial Sequence
  Synthetic oligonucleotide
ggcaucaauauccuaaccc

SEQ ID NO: 20987 - RNA, 19 nt, Artificial Sequence
  Synthetic oligonucleotide
gcaucaauauccuaaccca

SEQ ID NO: 20988 - RNA, 19 nt, Artificial Sequence
  Synthetic oligonucleotide
caucaauauccuaacccac

SEQ ID NO: 20989 - RNA, 19 nt, Artificial Sequence
  Synthetic oligonucleotide
aucaauauccuaacccacc

SEQ ID NO: 20990 - RNA, 19 nt, Artificial Sequence
  Synthetic oligonucleotide
ucaauauccuaacccaccu

SEQ ID NO: 20991 - RNA, 19 nt, Artificial Sequence
  Synthetic oligonucleotide
caauauccuaacccaccuc

SEQ ID NO: 20992 - RNA, 19 nt, Artificial Sequence
  Synthetic oligonucleotide
aauauccuaacccaccucc

SEQ ID NO: 20993 - RNA, 19 nt, Artificial Sequence
  Synthetic oligonucleotide
cuaacccaccuccccaaag

SEQ ID NO: 20994 - RNA, 19 nt, Artificial Sequence
  Synthetic oligonucleotide
uaacccaccuccccaaagg

SEQ ID NO: 20995 - RNA, 19 nt, Artificial Sequence
  Synthetic oligonucleotide
aacccaccuccccaaaggg

SEQ ID NO: 20996 - RNA, 19 nt, Artificial Sequence
  Synthetic oligonucleotide
cagaggcggagcugaugag

SEQ ID NO: 20997 - RNA, 19 nt, Artificial Sequence
  Synthetic oligonucleotide
aggcggagcugaugagcgu

SEQ ID NO: 20998 - RNA, 19 nt, Artificial Sequence
  Synthetic oligonucleotide
ggcggagcugaugagcguu

SEQ ID NO: 20999 - RNA, 19 nt, Artificial Sequence
  Synthetic oligonucleotide
gcggagcugaugagcguug

SEQ ID NO: 21000 - RNA, 19 nt, Artificial Sequence
  Synthetic oligonucleotide
cggagcugaugagcguugu

SEQ ID NO: 21001 - RNA, 19 nt, Artificial Sequence
  Synthetic oligonucleotide
ggagcugaugagcguuguc

SEQ ID NO: 21002 - RNA, 19 nt, Artificial Sequence
  Synthetic oligonucleotide
gagcugaugagcguugucc

SEQ ID NO: 21003 - RNA, 19 nt, Artificial Sequence
  Synthetic oligonucleotide
agcugaugagcguuguccc

SEQ ID NO: 21004 - RNA, 19 nt, Artificial Sequence
  Synthetic oligonucleotide
gcugaugagcguuguccca

SEQ ID NO: 21005 - RNA, 19 nt, Artificial Sequence
  Synthetic oligonucleotide
cugaugagcguugucccag

SEQ ID NO: 21006 - RNA, 19 nt, Artificial Sequence
  Synthetic oligonucleotide
ugaugagcguugucccagu

SEQ ID NO: 21007 - RNA, 19 nt, Artificial Sequence
  Synthetic oligonucleotide
gaugagcguugucccagua

SEQ ID NO: 21008 - RNA, 19 nt, Artificial Sequence
  Synthetic oligonucleotide
augagcguugucccaguau

SEQ ID NO: 21009 - RNA, 19 nt, Artificial Sequence
  Synthetic oligonucleotide
ugagcguugucccaguauu

SEQ ID NO: 21010 - RNA, 19 nt, Artificial Sequence
  Synthetic oligonucleotide
gagcguugucccaguauuc

SEQ ID NO: 21011 - RNA, 19 nt, Artificial Sequence
  Synthetic oligonucleotide
agcguugucccaguauucu

SEQ ID NO: 21012 - RNA, 19 nt, Artificial Sequence
  Synthetic oligonucleotide
gcguugucccaguauucua

SEQ ID NO: 21013 - RNA, 19 nt, Artificial Sequence
  Synthetic oligonucleotide
cguugucccaguauucuau

SEQ ID NO: 21014 - RNA, 19 nt, Artificial Sequence
  Synthetic oligonucleotide
guugucccaguauucuaug

SEQ ID NO: 21015 - RNA, 19 nt, Artificial Sequence
  Synthetic oligonucleotide
uugucccaguauucuaugu

SEQ ID NO: 21016 - RNA, 19 nt, Artificial Sequence
  Synthetic oligonucleotide
ugucccaguauucuauguu

SEQ ID NO: 21017 - RNA, 19 nt, Artificial Sequence
  Synthetic oligonucleotide
gucccaguauucuauguuu

SEQ ID NO: 21018 - RNA, 19 nt, Artificial Sequence
  Synthetic oligonucleotide
cccaguauucuauguuuuu

SEQ ID NO: 21019 - RNA, 19 nt, Artificial Sequence
  Synthetic oligonucleotide
ccaguauucuauguuuuuc

SEQ ID NO: 21020 - RNA, 19 nt, Artificial Sequence
  Synthetic oligonucleotide
caguauucuauguuuuuca

SEQ ID NO: 21021 - RNA, 19 nt, Artificial Sequence
  Synthetic oligonucleotide
aguauucuauguuuuucac

SEQ ID NO: 21022 - RNA, 19 nt, Artificial Sequence
  Synthetic oligonucleotide
guauucuauguuuuucacu

SEQ ID NO: 21023 - RNA, 19 nt, Artificial Sequence
  Synthetic oligonucleotide
uauucuauguuuuucacua

SEQ ID NO: 21024 - RNA, 19 nt, Artificial Sequence
  Synthetic oligonucleotide
auucuauguuuuucacuac

SEQ ID NO: 21025 - RNA, 19 nt, Artificial Sequence
  Synthetic oligonucleotide
uucuauguuuuucacuacc

SEQ ID NO: 21026 - RNA, 19 nt, Artificial Sequence
  Synthetic oligonucleotide
ucuauguuuuucacuaccu

SEQ ID NO: 21027 - RNA, 19 nt, Artificial Sequence
  Synthetic oligonucleotide
cuauguuuuucacuaccug

SEQ ID NO: 21028 - RNA, 19 nt, Artificial Sequence
  Synthetic oligonucleotide
uauguuuuucacuaccugg

SEQ ID NO: 21029 - RNA, 19 nt, Artificial Sequence
  Synthetic oligonucleotide
auguuuuucacuaccugga

SEQ ID NO: 21030 - RNA, 19 nt, Artificial Sequence
  Synthetic oligonucleotide
uguuuuucacuaccuggaa

SEQ ID NO: 21031 - RNA, 19 nt, Artificial Sequence
  Synthetic oligonucleotide
guuuuucacuaccuggaaa

SEQ ID NO: 21032 - RNA, 19 nt, Artificial Sequence
  Synthetic oligonucleotide
uuuuucacuaccuggaaac

SEQ ID NO: 21033 - RNA, 19 nt, Artificial Sequence
  Synthetic oligonucleotide
uuuucacuaccuggaaaca

SEQ ID NO: 21034 - RNA, 19 nt, Artificial Sequence
  Synthetic oligonucleotide
uuucacuaccuggaaacag

SEQ ID NO: 21035 - RNA, 19 nt, Artificial Sequence
  Synthetic oligonucleotide
uucacuaccuggaaacagg

SEQ ID NO: 21036 - RNA, 19 nt, Artificial Sequence
  Synthetic oligonucleotide
ucacuaccuggaaacagga

SEQ ID NO: 21037 - RNA, 19 nt, Artificial Sequence
  Synthetic oligonucleotide
cacuaccuggaaacaggaa

SEQ ID NO: 21038 - RNA, 19 nt, Artificial Sequence
  Synthetic oligonucleotide
acuaccuggaaacaggaaa

SEQ ID NO: 21039 - RNA, 19 nt, Artificial Sequence
  Synthetic oligonucleotide
cuaccuggaaacaggaaau

SEQ ID NO: 21040 - RNA, 19 nt, Artificial Sequence
  Synthetic oligonucleotide
uaccuggaaacaggaaauc

SEQ ID NO: 21041 - RNA, 19 nt, Artificial Sequence
  Synthetic oligonucleotide
accuggaaacaggaaauca

SEQ ID NO: 21042 - RNA, 19 nt, Artificial Sequence
  Synthetic oligonucleotide
ccuggaaacaggaaaucau

SEQ ID NO: 21043 - RNA, 19 nt, Artificial Sequence
  Synthetic oligonucleotide
cuggaaacaggaaaucauu

SEQ ID NO: 21044 - RNA, 19 nt, Artificial Sequence
  Synthetic oligonucleotide
uggaaacaggaaaucauug

SEQ ID NO: 21045 - RNA, 19 nt, Artificial Sequence
  Synthetic oligonucleotide
ggaaacaggaaaucauugg

SEQ ID NO: 21046 - RNA, 19 nt, Artificial Sequence
  Synthetic oligonucleotide
gaaacaggaaaucauugga

SEQ ID NO: 21047 - RNA, 19 nt, Artificial Sequence
  Synthetic oligonucleotide
aaacaggaaaucauuggaa

SEQ ID NO: 21048 - RNA, 19 nt, Artificial Sequence
  Synthetic oligonucleotide
aacaggaaaucauuggaac

SEQ ID NO: 21049 - RNA, 19 nt, Artificial Sequence
  Synthetic oligonucleotide
aggaaaucauuggaacauu

SEQ ID NO: 21050 - RNA, 19 nt, Artificial Sequence
  Synthetic oligonucleotide
ggaaaucauuggaacauuu

SEQ ID NO: 21051 - RNA, 19 nt, Artificial Sequence
  Synthetic oligonucleotide
gaaaucauuggaacauuuu

SEQ ID NO: 21052 - RNA, 19 nt, Artificial Sequence
  Synthetic oligonucleotide
aaaucauuggaacauuuuu

SEQ ID NO: 21053 - RNA, 19 nt, Artificial Sequence
  Synthetic oligonucleotide
aaucauuggaacauuuuuc

SEQ ID NO: 21054 - RNA, 19 nt, Artificial Sequence
  Synthetic oligonucleotide
aucauuggaacauuuuuca

SEQ ID NO: 21055 - RNA, 19 nt, Artificial Sequence
  Synthetic oligonucleotide
ucauuggaacauuuuucau

SEQ ID NO: 21056 - RNA, 19 nt, Artificial Sequence
  Synthetic oligonucleotide
cugacccauuaauugaaaa

SEQ ID NO: 21057 - RNA, 19 nt, Artificial Sequence
  Synthetic oligonucleotide
gaagaaaaaauuaaaagaa

SEQ ID NO: 21058 - RNA, 19 nt, Artificial Sequence
  Synthetic oligonucleotide
aagaaaaaauuaaaagaag

SEQ ID NO: 21059 - RNA, 19 nt, Artificial Sequence
  Synthetic oligonucleotide
agaaaaaauuaaaagaagg

SEQ ID NO: 21060 - RNA, 19 nt, Artificial Sequence
  Synthetic oligonucleotide
gaaaaaauuaaaagaaggg

SEQ ID NO: 21061 - RNA, 19 nt, Artificial Sequence
  Synthetic oligonucleotide
aaaaaauuaaaagaaggga

SEQ ID NO: 21062 - RNA, 19 nt, Artificial Sequence
  Synthetic oligonucleotide
guugagcauuauguccuac

SEQ ID NO: 21063 - RNA, 19 nt, Artificial Sequence
  Synthetic oligonucleotide
ugagcauuauguccuacag

SEQ ID NO: 21064 - RNA, 19 nt, Artificial Sequence
  Synthetic oligonucleotide
gagcauuauguccuacaga

SEQ ID NO: 21065 - RNA, 19 nt, Artificial Sequence
  Synthetic oligonucleotide
agcauuauguccuacagaa

SEQ ID NO: 21066 - RNA, 19 nt, Artificial Sequence
  Synthetic oligonucleotide
gcauuauguccuacagaaa

SEQ ID NO: 21067 - RNA, 19 nt, Artificial Sequence
  Synthetic oligonucleotide
cauuauguccuacagaaau

SEQ ID NO: 21068 - RNA, 19 nt, Artificial Sequence
  Synthetic oligonucleotide
auuauguccuacagaaaug

SEQ ID NO: 21069 - RNA, 19 nt, Artificial Sequence
  Synthetic oligonucleotide
uuauguccuacagaaaugc

SEQ ID NO: 21070 - RNA, 19 nt, Artificial Sequence
  Synthetic oligonucleotide
uauguccuacagaaaugcu

SEQ ID NO: 21071 - RNA, 19 nt, Artificial Sequence
  Synthetic oligonucleotide
auguccuacagaaaugcug

SEQ ID NO: 21072 - RNA, 19 nt, Artificial Sequence
  Synthetic oligonucleotide
uguccuacagaaaugcuga

SEQ ID NO: 21073 - RNA, 19 nt, Artificial Sequence
  Synthetic oligonucleotide
guccuacagaaaugcugac

SEQ ID NO: 21074 - RNA, 19 nt, Artificial Sequence
  Synthetic oligonucleotide
gaagugcuagcacuugguu

SEQ ID NO: 21075 - RNA, 19 nt, Artificial Sequence
  Synthetic oligonucleotide
aagugcuagcacuugguua

SEQ ID NO: 21076 - RNA, 19 nt, Artificial Sequence
  Synthetic oligonucleotide
agugcuagcacuugguuaa

SEQ ID NO: 21077 - RNA, 19 nt, Artificial Sequence
  Synthetic oligonucleotide
gugcuagcacuugguuaac

SEQ ID NO: 21078 - RNA, 19 nt, Artificial Sequence
  Synthetic oligonucleotide
ugcuagcacuugguuaaca

SEQ ID NO: 21079 - RNA, 19 nt, Artificial Sequence
  Synthetic oligonucleotide
gcuagcacuugguuaacag

SEQ ID NO: 21080 - RNA, 19 nt, Artificial Sequence
  Synthetic oligonucleotide
cuagcacuugguuaacagc

SEQ ID NO: 21081 - RNA, 19 nt, Artificial Sequence
  Synthetic oligonucleotide
uagcacuugguuaacagcu

SEQ ID NO: 21082 - RNA, 19 nt, Artificial Sequence
  Synthetic oligonucleotide
agcacuugguuaacagcuu

SEQ ID NO: 21083 - RNA, 19 nt, Artificial Sequence
  Synthetic oligonucleotide
gcacuugguuaacagcuuu

SEQ ID NO: 21084 - RNA, 19 nt, Artificial Sequence
  Synthetic oligonucleotide
acuugguuaacagcuuuug

SEQ ID NO: 21085 - RNA, 19 nt, Artificial Sequence
  Synthetic oligonucleotide
cuugguuaacagcuuuugc

SEQ ID NO: 21086 - RNA, 19 nt, Artificial Sequence
  Synthetic oligonucleotide
gguuaacagcuuuugcuuu

SEQ ID NO: 21087 - RNA, 19 nt, Artificial Sequence
  Synthetic oligonucleotide
guuaacagcuuuugcuuua

SEQ ID NO: 21088 - RNA, 19 nt, Artificial Sequence
  Synthetic oligonucleotide
uuaacagcuuuugcuuuaa

SEQ ID NO: 21089 - RNA, 19 nt, Artificial Sequence
  Synthetic oligonucleotide
uaacagcuuuugcuuuaag

SEQ ID NO: 21090 - RNA, 19 nt, Artificial Sequence
  Synthetic oligonucleotide
aacagcuuuugcuuuaaga

SEQ ID NO: 21091 - RNA, 19 nt, Artificial Sequence
  Synthetic oligonucleotide
acagcuuuugcuuuaagag

SEQ ID NO: 21092 - RNA, 19 nt, Artificial Sequence
  Synthetic oligonucleotide
cagcuuuugcuuuaagagu

SEQ ID NO: 21093 - RNA, 19 nt, Artificial Sequence
  Synthetic oligonucleotide
agcuuuugcuuuaagagua

SEQ ID NO: 21094 - RNA, 19 nt, Artificial Sequence
  Synthetic oligonucleotide
gcuuuugcuuuaagaguac

SEQ ID NO: 21095 - RNA, 19 nt, Artificial Sequence
  Synthetic oligonucleotide
cuuuugcuuuaagaguacu

SEQ ID NO: 21096 - RNA, 19 nt, Artificial Sequence
  Synthetic oligonucleotide
uuuugcuuuaagaguacuu

SEQ ID NO: 21097 - RNA, 19 nt, Artificial Sequence
  Synthetic oligonucleotide
uuugcuuuaagaguacuug

SEQ ID NO: 21098 - RNA, 19 nt, Artificial Sequence
  Synthetic oligonucleotide
gcuuuaagaguacuuggac

SEQ ID NO: 21099 - RNA, 19 nt, Artificial Sequence
  Synthetic oligonucleotide
cuuuaagaguacuuggaca

SEQ ID NO: 21100 - RNA, 19 nt, Artificial Sequence
  Synthetic oligonucleotide
acguagagcagaaccaaaa

SEQ ID NO: 21101 - RNA, 19 nt, Artificial Sequence
  Synthetic oligonucleotide
uuuguaauucuuuauugug

SEQ ID NO: 21102 - RNA, 19 nt, Artificial Sequence
  Synthetic oligonucleotide
uuguaauucuuuauugugg

SEQ ID NO: 21103 - RNA, 19 nt, Artificial Sequence
  Synthetic oligonucleotide
cuuucaaggaaaauucaca

SEQ ID NO: 21104 - RNA, 19 nt, Artificial Sequence
  Synthetic oligonucleotide
uuucaaggaaaauucacag

SEQ ID NO: 21105 - RNA, 19 nt, Artificial Sequence
  Synthetic oligonucleotide
uucaaggaaaauucacagu

SEQ ID NO: 21106 - RNA, 19 nt, Artificial Sequence
  Synthetic oligonucleotide
ucaaggaaaauucacagua

SEQ ID NO: 21107 - RNA, 19 nt, Artificial Sequence
  Synthetic oligonucleotide
caaggaaaauucacaguau

SEQ ID NO: 21108 - RNA, 19 nt, Artificial Sequence
  Synthetic oligonucleotide
aaggaaaauucacaguauc

SEQ ID NO: 21109 - RNA, 19 nt, Artificial Sequence
  Synthetic oligonucleotide
aggaaaauucacaguauca

SEQ ID NO: 21110 - RNA, 19 nt, Artificial Sequence
  Synthetic oligonucleotide
ggaaaauucacaguaucaa

SEQ ID NO: 21111 - RNA, 19 nt, Artificial Sequence
  Synthetic oligonucleotide
gaaaauucacaguaucaac

SEQ ID NO: 21112 - RNA, 19 nt, Artificial Sequence
  Synthetic oligonucleotide
aaaauucacaguaucaacc

SEQ ID NO: 21113 - RNA, 19 nt, Artificial Sequence
  Synthetic oligonucleotide
aaauucacaguaucaacca

SEQ ID NO: 21114 - RNA, 19 nt, Artificial Sequence
  Synthetic oligonucleotide
aauucacaguaucaaccaa

SEQ ID NO: 21115 - RNA, 19 nt, Artificial Sequence
  Synthetic oligonucleotide
auucacaguaucaaccaau

SEQ ID NO: 21116 - RNA, 19 nt, Artificial Sequence
  Synthetic oligonucleotide
ucacaguaucaaccaauaa

SEQ ID NO: 21117 - RNA, 19 nt, Artificial Sequence
  Synthetic oligonucleotide
cacaguaucaaccaauaaa

SEQ ID NO: 21118 - RNA, 19 nt, Artificial Sequence
  Synthetic oligonucleotide
acaguaucaaccaauaaaa

SEQ ID NO: 21119 - RNA, 19 nt, Artificial Sequence
  Synthetic oligonucleotide
caguaucaaccaauaaaau

SEQ ID NO: 21120 - RNA, 19 nt, Artificial Sequence
  Synthetic oligonucleotide
aguaucaaccaauaaaauu

SEQ ID NO: 21121 - RNA, 19 nt, Artificial Sequence
  Synthetic oligonucleotide
guaucaaccaauaaaauua

SEQ ID NO: 21122 - RNA, 19 nt, Artificial Sequence
  Synthetic oligonucleotide
uaucaaccaauaaaauuac

SEQ ID NO: 21123 - RNA, 19 nt, Artificial Sequence
  Synthetic oligonucleotide
cacagcucuaauuaaagcu

SEQ ID NO: 21124 - RNA, 19 nt, Artificial Sequence
  Synthetic oligonucleotide
acagcucuaauuaaagcug

SEQ ID NO: 21125 - RNA, 19 nt, Artificial Sequence
  Synthetic oligonucleotide
cagcucuaauuaaagcuga

SEQ ID NO: 21126 - RNA, 19 nt, Artificial Sequence
  Synthetic oligonucleotide
aacuuucugcuugaaaaua

SEQ ID NO: 21127 - RNA, 19 nt, Artificial Sequence
  Synthetic oligonucleotide
acuuucugcuugaaaauac

SEQ ID NO: 21128 - RNA, 19 nt, Artificial Sequence
  Synthetic oligonucleotide
cuuucugcuugaaaauaca

SEQ ID NO: 21129 - RNA, 19 nt, Artificial Sequence
  Synthetic oligonucleotide
uuucugcuugaaaauacac

SEQ ID NO: 21130 - RNA, 19 nt, Artificial Sequence
  Synthetic oligonucleotide
uucugcuugaaaauacacu

SEQ ID NO: 21131 - RNA, 19 nt, Artificial Sequence
  Synthetic oligonucleotide
ucugcuugaaaauacacug

SEQ ID NO: 21132 - RNA, 19 nt, Artificial Sequence
  Synthetic oligonucleotide
cugcuugaaaauacacugc

SEQ ID NO: 21133 - RNA, 19 nt, Artificial Sequence
  Synthetic oligonucleotide
ugcuugaaaauacacugcc

SEQ ID NO: 21134 - RNA, 19 nt, Artificial Sequence
  Synthetic oligonucleotide
gcuugaaaauacacugcca

SEQ ID NO: 21135 - RNA, 19 nt, Artificial Sequence
  Synthetic oligonucleotide
cuugaaaauacacugccag

SEQ ID NO: 21136 - RNA, 19 nt, Artificial Sequence
  Synthetic oligonucleotide
uugaaaauacacugccagc

SEQ ID NO: 21137 - RNA, 19 nt, Artificial Sequence
  Synthetic oligonucleotide
ugaaaauacacugccagcc

SEQ ID NO: 21138 - RNA, 19 nt, Artificial Sequence
  Synthetic oligonucleotide
gaaaauacacugccagccc

SEQ ID NO: 21139 - RNA, 19 nt, Artificial Sequence
  Synthetic oligonucleotide
aaaauacacugccagccca

SEQ ID NO: 21140 - RNA, 19 nt, Artificial Sequence
  Synthetic oligonucleotide
aaauacacugccagcccag

SEQ ID NO: 21141 - RNA, 19 nt, Artificial Sequence
  Synthetic oligonucleotide
aauacacugccagcccaga

SEQ ID NO: 21142 - RNA, 19 nt, Artificial Sequence
  Synthetic oligonucleotide
auacacugccagcccagag

SEQ ID NO: 21143 - RNA, 19 nt, Artificial Sequence
  Synthetic oligonucleotide
uacacugccagcccagagc

SEQ ID NO: 21144 - RNA, 19 nt, Artificial Sequence
  Synthetic oligonucleotide
acacugccagcccagagca

SEQ ID NO: 21145 - RNA, 19 nt, Artificial Sequence
  Synthetic oligonucleotide
cacugccagcccagagcac

SEQ ID NO: 21146 - RNA, 19 nt, Artificial Sequence
  Synthetic oligonucleotide
acugccagcccagagcacc

SEQ ID NO: 21147 - RNA, 19 nt, Artificial Sequence
  Synthetic oligonucleotide
cugccagcccagagcaccu

SEQ ID NO: 21148 - RNA, 19 nt, Artificial Sequence
  Synthetic oligonucleotide
ugccagcccagagcaccuu

SEQ ID NO: 21149 - RNA, 19 nt, Artificial Sequence
  Synthetic oligonucleotide
gccagcccagagcaccuuu

SEQ ID NO: 21150 - RNA, 19 nt, Artificial Sequence
  Synthetic oligonucleotide
ccagcccagagcaccuuua

SEQ ID NO: 21151 - RNA, 19 nt, Artificial Sequence
  Synthetic oligonucleotide
cagcccagagcaccuuuac

SEQ ID NO: 21152 - RNA, 19 nt, Artificial Sequence
  Synthetic oligonucleotide
agcccagagcaccuuuaca

SEQ ID NO: 21153 - RNA, 19 nt, Artificial Sequence
  Synthetic oligonucleotide
gcccagagcaccuuuacau

SEQ ID NO: 21154 - RNA, 19 nt, Artificial Sequence
  Synthetic oligonucleotide
cccagagcaccuuuacauu

SEQ ID NO: 21155 - RNA, 19 nt, Artificial Sequence
  Synthetic oligonucleotide
ccagagcaccuuuacauug

SEQ ID NO: 21156 - RNA, 19 nt, Artificial Sequence
  Synthetic oligonucleotide
cagagcaccuuuacauugg

SEQ ID NO: 21157 - RNA, 19 nt, Artificial Sequence
  Synthetic oligonucleotide
agagcaccuuuacauuggc

SEQ ID NO: 21158 - RNA, 19 nt, Artificial Sequence
  Synthetic oligonucleotide
gagcaccuuuacauuggcc

SEQ ID NO: 21159 - RNA, 19 nt, Artificial Sequence
  Synthetic oligonucleotide
agcaccuuuacauuggcca

SEQ ID NO: 21160 - RNA, 19 nt, Artificial Sequence
  Synthetic oligonucleotide
gcaccuuuacauuggccau

SEQ ID NO: 21161 - RNA, 19 nt, Artificial Sequence
  Synthetic oligonucleotide
caccuuuacauuggccauu

SEQ ID NO: 21162 - RNA, 19 nt, Artificial Sequence
  Synthetic oligonucleotide
accuuuacauuggccauuu

SEQ ID NO: 21163 - RNA, 19 nt, Artificial Sequence
  Synthetic oligonucleotide
ccuuuacauuggccauuuc

SEQ ID NO: 21164 - RNA, 19 nt, Artificial Sequence
  Synthetic oligonucleotide
cuuuacauuggccauuucu

SEQ ID NO: 21165 - RNA, 19 nt, Artificial Sequence
  Synthetic oligonucleotide
cguaugcucuuucccuggg

SEQ ID NO: 21166 - RNA, 19 nt, Artificial Sequence
  Synthetic oligonucleotide
guaugcucuuucccuggga

SEQ ID NO: 21167 - RNA, 19 nt, Artificial Sequence
  Synthetic oligonucleotide
uaugcucuuucccugggag

SEQ ID NO: 21168 - RNA, 19 nt, Artificial Sequence
  Synthetic oligonucleotide
augcucuuucccugggaga

SEQ ID NO: 21169 - RNA, 19 nt, Artificial Sequence
  Synthetic oligonucleotide
ugcucuuucccugggagau

SEQ ID NO: 21170 - RNA, 19 nt, Artificial Sequence
  Synthetic oligonucleotide
gcucuuucccugggagaua

SEQ ID NO: 21171 - RNA, 19 nt, Artificial Sequence
  Synthetic oligonucleotide
cucuuucccugggagauaa

SEQ ID NO: 21172 - RNA, 19 nt, Artificial Sequence
  Synthetic oligonucleotide
ucuuucccugggagauaaa

SEQ ID NO: 21173 - RNA, 19 nt, Artificial Sequence
  Synthetic oligonucleotide
cuuucccugggagauaaaa

SEQ ID NO: 21174 - RNA, 19 nt, Artificial Sequence
  Synthetic oligonucleotide
uuucccugggagauaaaac

SEQ ID NO: 21175 - RNA, 19 nt, Artificial Sequence
  Synthetic oligonucleotide
uucccugggagauaaaacu

SEQ ID NO: 21176 - RNA, 19 nt, Artificial Sequence
  Synthetic oligonucleotide
ucccugggagauaaaacuc

SEQ ID NO: 21177 - RNA, 19 nt, Artificial Sequence
  Synthetic oligonucleotide
cccugggagauaaaacuca

SEQ ID NO: 21178 - RNA, 19 nt, Artificial Sequence
  Synthetic oligonucleotide
ccugggagauaaaacucac

SEQ ID NO: 21179 - RNA, 19 nt, Artificial Sequence
  Synthetic oligonucleotide
cugggagauaaaacucacc

SEQ ID NO: 21180 - RNA, 19 nt, Artificial Sequence
  Synthetic oligonucleotide
ugggagauaaaacucaccc

SEQ ID NO: 21181 - RNA, 19 nt, Artificial Sequence
  Synthetic oligonucleotide
gggagauaaaacucaccca

SEQ ID NO: 21182 - RNA, 19 nt, Artificial Sequence
  Synthetic oligonucleotide
ggagauaaaacucacccac

SEQ ID NO: 21183 - RNA, 19 nt, Artificial Sequence
  Synthetic oligonucleotide
gagauaaaacucacccaca

SEQ ID NO: 21184 - RNA, 19 nt, Artificial Sequence
  Synthetic oligonucleotide
agauaaaacucacccacag

SEQ ID NO: 21185 - RNA, 19 nt, Artificial Sequence
  Synthetic oligonucleotide
gauaaaacucacccacagu

SEQ ID NO: 21186 - RNA, 19 nt, Artificial Sequence
  Synthetic oligonucleotide
ucguucaauuguuucagcu

SEQ ID NO: 21187 - RNA, 19 nt, Artificial Sequence
  Synthetic oligonucleotide
guucaauuguuucagcuuu

SEQ ID NO: 21188 - RNA, 19 nt, Artificial Sequence
  Synthetic oligonucleotide
uucaauuguuucagcuuug

SEQ ID NO: 21189 - RNA, 19 nt, Artificial Sequence
  Synthetic oligonucleotide
ucaauuguuucagcuuuga

SEQ ID NO: 21190 - RNA, 19 nt, Artificial Sequence
  Synthetic oligonucleotide
caauuguuucagcuuugaa

SEQ ID NO: 21191 - RNA, 19 nt, Artificial Sequence
  Synthetic oligonucleotide
aauuguuucagcuuugaag

SEQ ID NO: 21192 - RNA, 19 nt, Artificial Sequence
  Synthetic oligonucleotide
auuguuucagcuuugaaga

SEQ ID NO: 21193 - RNA, 19 nt, Artificial Sequence
  Synthetic oligonucleotide
uuguuucagcuuugaagag

SEQ ID NO: 21194 - RNA, 19 nt, Artificial Sequence
  Synthetic oligonucleotide
uguuucagcuuugaagaga

SEQ ID NO: 21195 - RNA, 19 nt, Artificial Sequence
  Synthetic oligonucleotide
guuucagcuuugaagagag

SEQ ID NO: 21196 - RNA, 19 nt, Artificial Sequence
  Synthetic oligonucleotide
uuucagcuuugaagagaga

SEQ ID NO: 21197 - RNA, 19 nt, Artificial Sequence
  Synthetic oligonucleotide
uucagcuuugaagagagaa

SEQ ID NO: 21198 - RNA, 19 nt, Artificial Sequence
  Synthetic oligonucleotide
ucagcuuugaagagagaag

SEQ ID NO: 21199 - RNA, 19 nt, Artificial Sequence
  Synthetic oligonucleotide
cagcuuugaagagagaagc

SEQ ID NO: 21200 - RNA, 19 nt, Artificial Sequence
  Synthetic oligonucleotide
agcuuugaagagagaagcu

SEQ ID NO: 21201 - RNA, 19 nt, Artificial Sequence
  Synthetic oligonucleotide
gcuuugaagagagaagcuu

SEQ ID NO: 21202 - RNA, 19 nt, Artificial Sequence
  Synthetic oligonucleotide
cuuugaagagagaagcuuu

SEQ ID NO: 21203 - RNA, 19 nt, Artificial Sequence
  Synthetic oligonucleotide
uuugaagagagaagcuuug

SEQ ID NO: 21204 - RNA, 19 nt, Artificial Sequence
  Synthetic oligonucleotide
aagagagaagcuuugguua

SEQ ID NO: 21205 - RNA, 19 nt, Artificial Sequence
  Synthetic oligonucleotide
agagagaagcuuugguuaa

SEQ ID NO: 21206 - RNA, 19 nt, Artificial Sequence
  Synthetic oligonucleotide
gagagaagcuuugguuaaa

SEQ ID NO: 21207 - RNA, 19 nt, Artificial Sequence
  Synthetic oligonucleotide
agaagcuuugguuaaaggu

SEQ ID NO: 21208 - RNA, 19 nt, Artificial Sequence
  Synthetic oligonucleotide
gaagcuuugguuaaaggua

SEQ ID NO: 21209 - RNA, 19 nt, Artificial Sequence
  Synthetic oligonucleotide
aagcuuugguuaaagguaa

SEQ ID NO: 21210 - RNA, 19 nt, Artificial Sequence
  Synthetic oligonucleotide
agcuuugguuaaagguaau

SEQ ID NO: 21211 - RNA, 19 nt, Artificial Sequence
  Synthetic oligonucleotide
gcuuugguuaaagguaauc

SEQ ID NO: 21212 - RNA, 19 nt, Artificial Sequence
  Synthetic oligonucleotide
cuuugguuaaagguaaucc

SEQ ID NO: 21213 - RNA, 19 nt, Artificial Sequence
  Synthetic oligonucleotide
uuugguuaaagguaaucca

SEQ ID NO: 21214 - RNA, 19 nt, Artificial Sequence
  Synthetic oligonucleotide
uugguuaaagguaauccac

SEQ ID NO: 21215 - RNA, 19 nt, Artificial Sequence
  Synthetic oligonucleotide
ugguuaaagguaauccacc

SEQ ID NO: 21216 - RNA, 19 nt, Artificial Sequence
  Synthetic oligonucleotide
gguuaaagguaauccaccc

SEQ ID NO: 21217 - RNA, 19 nt, Artificial Sequence
  Synthetic oligonucleotide
guuaaagguaauccaccca

SEQ ID NO: 21218 - RNA, 19 nt, Artificial Sequence
  Synthetic oligonucleotide
uuaaagguaauccacccau

SEQ ID NO: 21219 - RNA, 19 nt, Artificial Sequence
  Synthetic oligonucleotide
uaaagguaauccacccauu

SEQ ID NO: 21220 - RNA, 19 nt, Artificial Sequence
  Synthetic oligonucleotide
aaagguaauccacccauuu

SEQ ID NO: 21221 - RNA, 19 nt, Artificial Sequence
  Synthetic oligonucleotide
aagguaauccacccauuua

SEQ ID NO: 21222 - RNA, 19 nt, Artificial Sequence
  Synthetic oligonucleotide
agguaauccacccauuuau

SEQ ID NO: 21223 - RNA, 19 nt, Artificial Sequence
  Synthetic oligonucleotide
gguaauccacccauuuauc

SEQ ID NO: 21224 - RNA, 19 nt, Artificial Sequence
  Synthetic oligonucleotide
guaauccacccauuuaucg

SEQ ID NO: 21225 - RNA, 19 nt, Artificial Sequence
  Synthetic oligonucleotide
uaauccacccauuuaucgu

SEQ ID NO: 21226 - RNA, 19 nt, Artificial Sequence
  Synthetic oligonucleotide
aauccacccauuuaucguu

SEQ ID NO: 21227 - RNA, 19 nt, Artificial Sequence
  Synthetic oligonucleotide
auccacccauuuaucguuu

SEQ ID NO: 21228 - RNA, 19 nt, Artificial Sequence
  Synthetic oligonucleotide
uccacccauuuaucguuuu

SEQ ID NO: 21229 - RNA, 19 nt, Artificial Sequence
  Synthetic oligonucleotide
ccacccauuuaucguuuuu

SEQ ID NO: 21230 - RNA, 19 nt, Artificial Sequence
  Synthetic oligonucleotide
cacccauuuaucguuuuug

SEQ ID NO: 21231 - RNA, 19 nt, Artificial Sequence
  Synthetic oligonucleotide
cccauuuaucguuuuugga

SEQ ID NO: 21232 - RNA, 19 nt, Artificial Sequence
  Synthetic oligonucleotide
ccauuuaucguuuuuggaa

SEQ ID NO: 21233 - RNA, 19 nt, Artificial Sequence
  Synthetic oligonucleotide
cauuuaucguuuuuggaaa

SEQ ID NO: 21234 - RNA, 19 nt, Artificial Sequence
  Synthetic oligonucleotide
auuuaucguuuuuggaaag

SEQ ID NO: 21235 - RNA, 19 nt, Artificial Sequence
  Synthetic oligonucleotide
uuuaucguuuuuggaaaga

SEQ ID NO: 21236 - RNA, 19 nt, Artificial Sequence
  Synthetic oligonucleotide
agcauaaagacagcucugu

SEQ ID NO: 21237 - RNA, 19 nt, Artificial Sequence
  Synthetic oligonucleotide
gcauaaagacagcucugua

SEQ ID NO: 21238 - RNA, 19 nt, Artificial Sequence
  Synthetic oligonucleotide
cauaaagacagcucuguac

SEQ ID NO: 21239 - RNA, 19 nt, Artificial Sequence
  Synthetic oligonucleotide
auaaagacagcucuguacc

SEQ ID NO: 21240 - RNA, 19 nt, Artificial Sequence
  Synthetic oligonucleotide
uaaagacagcucuguaccu

SEQ ID NO: 21241 - RNA, 19 nt, Artificial Sequence
  Synthetic oligonucleotide
aaagacagcucuguaccua

SEQ ID NO: 21242 - RNA, 19 nt, Artificial Sequence
  Synthetic oligonucleotide
aagacagcucuguaccuaa

SEQ ID NO: 21243 - RNA, 19 nt, Artificial Sequence
  Synthetic oligonucleotide
agacagcucuguaccuaac

SEQ ID NO: 21244 - RNA, 19 nt, Artificial Sequence
  Synthetic oligonucleotide
gacagcucuguaccuaaca

SEQ ID NO: 21245 - RNA, 19 nt, Artificial Sequence
  Synthetic oligonucleotide
acagcucuguaccuaacac

SEQ ID NO: 21246 - RNA, 19 nt, Artificial Sequence
  Synthetic oligonucleotide
cagcucuguaccuaacacu

SEQ ID NO: 21247 - RNA, 19 nt, Artificial Sequence
  Synthetic oligonucleotide
agcucuguaccuaacacug

SEQ ID NO: 21248 - RNA, 19 nt, Artificial Sequence
  Synthetic oligonucleotide
gcucuguaccuaacacugg

SEQ ID NO: 21249 - RNA, 19 nt, Artificial Sequence
  Synthetic oligonucleotide
cucuguaccuaacacuggu

SEQ ID NO: 21250 - RNA, 19 nt, Artificial Sequence
  Synthetic oligonucleotide
cggcacguaugguagaaac

SEQ ID NO: 21251 - RNA, 19 nt, Artificial Sequence
  Synthetic oligonucleotide
ggcacguaugguagaaaca

SEQ ID NO: 21252 - RNA, 19 nt, Artificial Sequence
  Synthetic oligonucleotide
gcacguaugguagaaacaa

SEQ ID NO: 21253 - RNA, 19 nt, Artificial Sequence
  Synthetic oligonucleotide
cacguaugguagaaacaac

SEQ ID NO: 21254 - RNA, 19 nt, Artificial Sequence
  Synthetic oligonucleotide
acguaugguagaaacaacu

SEQ ID NO: 21255 - RNA, 19 nt, Artificial Sequence
  Synthetic oligonucleotide
cguaugguagaaacaacug

SEQ ID NO: 21256 - RNA, 19 nt, Artificial Sequence
  Synthetic oligonucleotide
guaugguagaaacaacugc

SEQ ID NO: 21257 - RNA, 19 nt, Artificial Sequence
  Synthetic oligonucleotide
uaugguagaaacaacugcc

SEQ ID NO: 21258 - RNA, 19 nt, Artificial Sequence
  Synthetic oligonucleotide
augguagaaacaacugccu

SEQ ID NO: 21259 - RNA, 19 nt, Artificial Sequence
  Synthetic oligonucleotide
ugguagaaacaacugccua

SEQ ID NO: 21260 - RNA, 19 nt, Artificial Sequence
  Synthetic oligonucleotide
gguagaaacaacugccuau

SEQ ID NO: 21261 - RNA, 19 nt, Artificial Sequence
  Synthetic oligonucleotide
guagaaacaacugccuaug

SEQ ID NO: 21262 - RNA, 19 nt, Artificial Sequence
  Synthetic oligonucleotide
uagaaacaacugccuaugc

SEQ ID NO: 21263 - RNA, 19 nt, Artificial Sequence
  Synthetic oligonucleotide
agaaacaacugccuaugcu

SEQ ID NO: 21264 - RNA, 19 nt, Artificial Sequence
  Synthetic oligonucleotide
gaaacaacugccuaugcuu

SEQ ID NO: 21265 - RNA, 19 nt, Artificial Sequence
  Synthetic oligonucleotide
aaacaacugccuaugcuuu

SEQ ID NO: 21266 - RNA, 19 nt, Artificial Sequence
  Synthetic oligonucleotide
aacaacugccuaugcuuua

SEQ ID NO: 21267 - RNA, 19 nt, Artificial Sequence
  Synthetic oligonucleotide
acaacugccuaugcuuuac

SEQ ID NO: 21268 - RNA, 19 nt, Artificial Sequence
  Synthetic oligonucleotide
caacugccuaugcuuuacu

SEQ ID NO: 21269 - RNA, 19 nt, Artificial Sequence
  Synthetic oligonucleotide
aacugccuaugcuuuacuc

SEQ ID NO: 21270 - RNA, 19 nt, Artificial Sequence
  Synthetic oligonucleotide
acugccuaugcuuuacuca

SEQ ID NO: 21271 - RNA, 19 nt, Artificial Sequence
  Synthetic oligonucleotide
cugccuaugcuuuacucac

SEQ ID NO: 21272 - RNA, 19 nt, Artificial Sequence
  Synthetic oligonucleotide
ugccuaugcuuuacucacc

SEQ ID NO: 21273 - RNA, 19 nt, Artificial Sequence
  Synthetic oligonucleotide
gccuaugcuuuacucacca

SEQ ID NO: 21274 - RNA, 19 nt, Artificial Sequence
  Synthetic oligonucleotide
ccuaugcuuuacucaccag

SEQ ID NO: 21275 - RNA, 19 nt, Artificial Sequence
  Synthetic oligonucleotide
cuaugcuuuacucaccagu

SEQ ID NO: 21276 - RNA, 19 nt, Artificial Sequence
  Synthetic oligonucleotide
uaugcuuuacucaccaguc

SEQ ID NO: 21277 - RNA, 19 nt, Artificial Sequence
  Synthetic oligonucleotide
gcuuuacucaccagucuga

SEQ ID NO: 21278 - RNA, 19 nt, Artificial Sequence
  Synthetic oligonucleotide
cuuuacucaccagucugaa

SEQ ID NO: 21279 - RNA, 19 nt, Artificial Sequence
  Synthetic oligonucleotide
uuuacucaccagucugaac

SEQ ID NO: 21280 - RNA, 19 nt, Artificial Sequence
  Synthetic oligonucleotide
uuacucaccagucugaacu

SEQ ID NO: 21281 - RNA, 19 nt, Artificial Sequence
  Synthetic oligonucleotide
acucaccagucugaacuug

SEQ ID NO: 21282 - RNA, 19 nt, Artificial Sequence
  Synthetic oligonucleotide
cucaccagucugaacuuga

SEQ ID NO: 21283 - RNA, 19 nt, Artificial Sequence
  Synthetic oligonucleotide
ucaccagucugaacuugaa

SEQ ID NO: 21284 - RNA, 19 nt, Artificial Sequence
  Synthetic oligonucleotide
agucaucaaauggcuauca

SEQ ID NO: 21285 - RNA, 19 nt, Artificial Sequence
  Synthetic oligonucleotide
gucaucaaauggcuaucag

SEQ ID NO: 21286 - RNA, 19 nt, Artificial Sequence
  Synthetic oligonucleotide
ucaucaaauggcuaucaga

SEQ ID NO: 21287 - RNA, 19 nt, Artificial Sequence
  Synthetic oligonucleotide
caucaaauggcuaucagaa

SEQ ID NO: 21288 - RNA, 19 nt, Artificial Sequence
  Synthetic oligonucleotide
aucaaauggcuaucagaag

SEQ ID NO: 21289 - RNA, 19 nt, Artificial Sequence
  Synthetic oligonucleotide
ucaaauggcuaucagaaga

SEQ ID NO: 21290 - RNA, 19 nt, Artificial Sequence
  Synthetic oligonucleotide
caaauggcuaucagaagag

SEQ ID NO: 21291 - RNA, 19 nt, Artificial Sequence
  Synthetic oligonucleotide
aaauggcuaucagaagagc

SEQ ID NO: 21292 - RNA, 19 nt, Artificial Sequence
  Synthetic oligonucleotide
aauggcuaucagaagagca

SEQ ID NO: 21293 - RNA, 19 nt, Artificial Sequence
  Synthetic oligonucleotide
auggcuaucagaagagcag

SEQ ID NO: 21294 - RNA, 19 nt, Artificial Sequence
  Synthetic oligonucleotide
uggcuaucagaagagcaga

SEQ ID NO: 21295 - RNA, 19 nt, Artificial Sequence
  Synthetic oligonucleotide
ggcuaucagaagagcagag

SEQ ID NO: 21296 - RNA, 19 nt, Artificial Sequence
  Synthetic oligonucleotide
gcuaucagaagagcagagg

SEQ ID NO: 21297 - RNA, 19 nt, Artificial Sequence
  Synthetic oligonucleotide
cuaucagaagagcagaggu

SEQ ID NO: 21298 - RNA, 19 nt, Artificial Sequence
  Synthetic oligonucleotide
uaucagaagagcagaggua

SEQ ID NO: 21299 - RNA, 19 nt, Artificial Sequence
  Synthetic oligonucleotide
aucagaagagcagagguau

SEQ ID NO: 21300 - RNA, 19 nt, Artificial Sequence
  Synthetic oligonucleotide
ucagaagagcagagguaug

SEQ ID NO: 21301 - RNA, 19 nt, Artificial Sequence
  Synthetic oligonucleotide
gaagagcagagguauggag

SEQ ID NO: 21302 - RNA, 19 nt, Artificial Sequence
  Synthetic oligonucleotide
aagagcagagguauggagg

SEQ ID NO: 21303 - RNA, 19 nt, Artificial Sequence
  Synthetic oligonucleotide
agagcagagguauggaggu

SEQ ID NO: 21304 - RNA, 19 nt, Artificial Sequence
  Synthetic oligonucleotide
gagcagagguauggaggug

SEQ ID NO: 21305 - RNA, 19 nt, Artificial Sequence
  Synthetic oligonucleotide
agcagagguauggaggugg

SEQ ID NO: 21306 - RNA, 19 nt, Artificial Sequence
  Synthetic oligonucleotide
gcagagguauggagguggc

SEQ ID NO: 21307 - RNA, 19 nt, Artificial Sequence
  Synthetic oligonucleotide
cagagguauggagguggcu

SEQ ID NO: 21308 - RNA, 19 nt, Artificial Sequence
  Synthetic oligonucleotide
agagguauggagguggcuu

SEQ ID NO: 21309 - RNA, 19 nt, Artificial Sequence
  Synthetic oligonucleotide
gagguauggagguggcuuu

SEQ ID NO: 21310 - RNA, 19 nt, Artificial Sequence
  Synthetic oligonucleotide
agguauggagguggcuuuu

SEQ ID NO: 21311 - RNA, 19 nt, Artificial Sequence
  Synthetic oligonucleotide
gguauggagguggcuuuua

SEQ ID NO: 21312 - RNA, 19 nt, Artificial Sequence
  Synthetic oligonucleotide
guauggagguggcuuuuau

SEQ ID NO: 21313 - RNA, 19 nt, Artificial Sequence
  Synthetic oligonucleotide
uauggagguggcuuuuauu

SEQ ID NO: 21314 - RNA, 19 nt, Artificial Sequence
  Synthetic oligonucleotide
auggagguggcuuuuauuc

SEQ ID NO: 21315 - RNA, 19 nt, Artificial Sequence
  Synthetic oligonucleotide
uggagguggcuuuuauuca

SEQ ID NO: 21316 - RNA, 19 nt, Artificial Sequence
  Synthetic oligonucleotide
ggagguggcuuuuauucaa

SEQ ID NO: 21317 - RNA, 19 nt, Artificial Sequence
  Synthetic oligonucleotide
gagguggcuuuuauucaac

SEQ ID NO: 21318 - RNA, 19 nt, Artificial Sequence
  Synthetic oligonucleotide
agguggcuuuuauucaacc

SEQ ID NO: 21319 - RNA, 19 nt, Artificial Sequence
  Synthetic oligonucleotide
ggaauauucacuccugguu

SEQ ID NO: 21320 - RNA, 19 nt, Artificial Sequence
  Synthetic oligonucleotide
gaauauucacuccugguua

SEQ ID NO: 21321 - RNA, 19 nt, Artificial Sequence
  Synthetic oligonucleotide
aauauucacuccugguuaa

SEQ ID NO: 21322 - RNA, 19 nt, Artificial Sequence
  Synthetic oligonucleotide
auauucacuccugguuaaa

SEQ ID NO: 21323 - RNA, 19 nt, Artificial Sequence
  Synthetic oligonucleotide
gccuuacauaauuauaaaa

SEQ ID NO: 21324 - RNA, 19 nt, Artificial Sequence
  Synthetic oligonucleotide
ccuuacauaauuauaaaau

SEQ ID NO: 21325 - RNA, 19 nt, Artificial Sequence
  Synthetic oligonucleotide
cuuacauaauuauaaaaug

SEQ ID NO: 21326 - RNA, 19 nt, Artificial Sequence
  Synthetic oligonucleotide
uuacauaauuauaaaauga

SEQ ID NO: 21327 - RNA, 19 nt, Artificial Sequence
  Synthetic oligonucleotide
uacauaauuauaaaaugac

SEQ ID NO: 21328 - RNA, 19 nt, Artificial Sequence
  Synthetic oligonucleotide
acauaauuauaaaaugaca

SEQ ID NO: 21329 - RNA, 19 nt, Artificial Sequence
  Synthetic oligonucleotide
cauaauuauaaaaugacag

SEQ ID NO: 21330 - RNA, 19 nt, Artificial Sequence
  Synthetic oligonucleotide
auaauuauaaaaugacaga

SEQ ID NO: 21331 - RNA, 19 nt, Artificial Sequence
  Synthetic oligonucleotide
uaauuauaaaaugacagac

SEQ ID NO: 21332 - RNA, 19 nt, Artificial Sequence
  Synthetic oligonucleotide
aauuauaaaaugacagaca

SEQ ID NO: 21333 - RNA, 19 nt, Artificial Sequence
  Synthetic oligonucleotide
auuauaaaaugacagacaa

SEQ ID NO: 21334 - RNA, 19 nt, Artificial Sequence
  Synthetic oligonucleotide
uuauaaaaugacagacaag

SEQ ID NO: 21335 - RNA, 19 nt, Artificial Sequence
  Synthetic oligonucleotide
uauaaaaugacagacaaga

SEQ ID NO: 21336 - RNA, 19 nt, Artificial Sequence
  Synthetic oligonucleotide
auaaaaugacagacaagaa

SEQ ID NO: 21337 - RNA, 19 nt, Artificial Sequence
  Synthetic oligonucleotide
uaaaaugacagacaagaau

SEQ ID NO: 21338 - RNA, 19 nt, Artificial Sequence
  Synthetic oligonucleotide
aaaaugacagacaagaauu

SEQ ID NO: 21339 - RNA, 19 nt, Artificial Sequence
  Synthetic oligonucleotide
aaaugacagacaagaauuu

SEQ ID NO: 21340 - RNA, 19 nt, Artificial Sequence
  Synthetic oligonucleotide
aaugacagacaagaauuuc

SEQ ID NO: 21341 - RNA, 19 nt, Artificial Sequence
  Synthetic oligonucleotide
augacagacaagaauuucc

SEQ ID NO: 21342 - RNA, 19 nt, Artificial Sequence
  Synthetic oligonucleotide
ugacagacaagaauuuccu

SEQ ID NO: 21343 - RNA, 19 nt, Artificial Sequence
  Synthetic oligonucleotide
gacagacaagaauuuccuu

SEQ ID NO: 21344 - RNA, 19 nt, Artificial Sequence
  Synthetic oligonucleotide
acagacaagaauuuccuug

SEQ ID NO: 21345 - RNA, 19 nt, Artificial Sequence
  Synthetic oligonucleotide
cagacaagaauuuccuugg

SEQ ID NO: 21346 - RNA, 19 nt, Artificial Sequence
  Synthetic oligonucleotide
agacaagaauuuccuuggg

SEQ ID NO: 21347 - RNA, 19 nt, Artificial Sequence
  Synthetic oligonucleotide
gacaagaauuuccuuggga

SEQ ID NO: 21348 - RNA, 19 nt, Artificial Sequence
  Synthetic oligonucleotide
acaagaauuuccuugggag

SEQ ID NO: 21349 - RNA, 19 nt, Artificial Sequence
  Synthetic oligonucleotide
caagaauuuccuugggagg

SEQ ID NO: 21350 - RNA, 19 nt, Artificial Sequence
  Synthetic oligonucleotide
aagaauuuccuugggaggc

SEQ ID NO: 21351 - RNA, 19 nt, Artificial Sequence
  Synthetic oligonucleotide
uccuugggaggccaguaga

SEQ ID NO: 21352 - RNA, 19 nt, Artificial Sequence
  Synthetic oligonucleotide
uugggaggccaguagaggu

SEQ ID NO: 21353 - RNA, 19 nt, Artificial Sequence
  Synthetic oligonucleotide
ugggaggccaguagaggug

SEQ ID NO: 21354 - RNA, 19 nt, Artificial Sequence
  Synthetic oligonucleotide
gggaggccaguagaggugc

SEQ ID NO: 21355 - RNA, 19 nt, Artificial Sequence
  Synthetic oligonucleotide
ggaggccaguagaggugcu

SEQ ID NO: 21356 - RNA, 19 nt, Artificial Sequence
  Synthetic oligonucleotide
gaggccaguagaggugcuu

SEQ ID NO: 21357 - RNA, 19 nt, Artificial Sequence
  Synthetic oligonucleotide
aggccaguagaggugcuuc

SEQ ID NO: 21358 - RNA, 19 nt, Artificial Sequence
  Synthetic oligonucleotide
ggccaguagaggugcuucu

SEQ ID NO: 21359 - RNA, 19 nt, Artificial Sequence
  Synthetic oligonucleotide
gccaguagaggugcuucuc

SEQ ID NO: 21360 - RNA, 19 nt, Artificial Sequence
  Synthetic oligonucleotide
ccaguagaggugcuucuca

SEQ ID NO: 21361 - RNA, 19 nt, Artificial Sequence
  Synthetic oligonucleotide
caguagaggugcuucucaa

SEQ ID NO: 21362 - RNA, 19 nt, Artificial Sequence
  Synthetic oligonucleotide
aguagaggugcuucucaau

SEQ ID NO: 21363 - RNA, 19 nt, Artificial Sequence
  Synthetic oligonucleotide
guagaggugcuucucaaug

SEQ ID NO: 21364 - RNA, 19 nt, Artificial Sequence
  Synthetic oligonucleotide
uagaggugcuucucaauga

SEQ ID NO: 21365 - RNA, 19 nt, Artificial Sequence
  Synthetic oligonucleotide
agaggugcuucucaaugau

SEQ ID NO: 21366 - RNA, 19 nt, Artificial Sequence
  Synthetic oligonucleotide
gaggugcuucucaaugaug

SEQ ID NO: 21367 - RNA, 19 nt, Artificial Sequence
  Synthetic oligonucleotide
aggugcuucucaaugauga

SEQ ID NO: 21368 - RNA, 19 nt, Artificial Sequence
  Synthetic oligonucleotide
ggugcuucucaaugaugac

SEQ ID NO: 21369 - RNA, 19 nt, Artificial Sequence
  Synthetic oligonucleotide
gugcuucucaaugaugacc

SEQ ID NO: 21370 - RNA, 19 nt, Artificial Sequence
  Synthetic oligonucleotide
cauugucaguacaggauuu

SEQ ID NO: 21371 - RNA, 19 nt, Artificial Sequence
  Synthetic oligonucleotide
auugucaguacaggauuug

SEQ ID NO: 21372 - RNA, 19 nt, Artificial Sequence
  Synthetic oligonucleotide
uugucaguacaggauuugg

SEQ ID NO: 21373 - RNA, 19 nt, Artificial Sequence
  Synthetic oligonucleotide
ugucaguacaggauuuggc

SEQ ID NO: 21374 - RNA, 19 nt, Artificial Sequence
  Synthetic oligonucleotide
gucaguacaggauuuggca

SEQ ID NO: 21375 - RNA, 19 nt, Artificial Sequence
  Synthetic oligonucleotide
ucaguacaggauuuggcag

SEQ ID NO: 21376 - RNA, 19 nt, Artificial Sequence
  Synthetic oligonucleotide
caguacaggauuuggcagu

SEQ ID NO: 21377 - RNA, 19 nt, Artificial Sequence
  Synthetic oligonucleotide
aguacaggauuuggcagug

SEQ ID NO: 21378 - RNA, 19 nt, Artificial Sequence
  Synthetic oligonucleotide
guacaggauuuggcagugg

SEQ ID NO: 21379 - RNA, 19 nt, Artificial Sequence
  Synthetic oligonucleotide
uacaggauuuggcaguggc

SEQ ID NO: 21380 - RNA, 19 nt, Artificial Sequence
  Synthetic oligonucleotide
acaggauuuggcaguggcu

SEQ ID NO: 21381 - RNA, 19 nt, Artificial Sequence
  Synthetic oligonucleotide
aggauuuggcaguggcuug

SEQ ID NO: 21382 - RNA, 19 nt, Artificial Sequence
  Synthetic oligonucleotide
ggauuuggcaguggcuugg

SEQ ID NO: 21383 - RNA, 19 nt, Artificial Sequence
  Synthetic oligonucleotide
gauuuggcaguggcuuggc

SEQ ID NO: 21384 - RNA, 19 nt, Artificial Sequence
  Synthetic oligonucleotide
auuuggcaguggcuuggcu

SEQ ID NO: 21385 - RNA, 19 nt, Artificial Sequence
  Synthetic oligonucleotide
caguacauguaacaacugu

SEQ ID NO: 21386 - RNA, 19 nt, Artificial Sequence
  Synthetic oligonucleotide
aguacauguaacaacugua

SEQ ID NO: 21387 - RNA, 19 nt, Artificial Sequence
  Synthetic oligonucleotide
guacauguaacaacuguag

SEQ ID NO: 21388 - RNA, 19 nt, Artificial Sequence
  Synthetic oligonucleotide
acauguaacaacuguaguu

SEQ ID NO: 21389 - RNA, 19 nt, Artificial Sequence
  Synthetic oligonucleotide
cauguaacaacuguaguuc

SEQ ID NO: 21390 - RNA, 19 nt, Artificial Sequence
  Synthetic oligonucleotide
auguaacaacuguaguuca

SEQ ID NO: 21391 - RNA, 19 nt, Artificial Sequence
  Synthetic oligonucleotide
uguaacaacuguaguucac

SEQ ID NO: 21392 - RNA, 19 nt, Artificial Sequence
  Synthetic oligonucleotide
guaacaacuguaguucaca

SEQ ID NO: 21393 - RNA, 19 nt, Artificial Sequence
  Synthetic oligonucleotide
uaacaacuguaguucacaa

SEQ ID NO: 21394 - RNA, 19 nt, Artificial Sequence
  Synthetic oligonucleotide
aacaacuguaguucacaaa

SEQ ID NO: 21395 - RNA, 19 nt, Artificial Sequence
  Synthetic oligonucleotide
acaacuguaguucacaaaa

SEQ ID NO: 21396 - RNA, 19 nt, Artificial Sequence
  Synthetic oligonucleotide
caacuguaguucacaaaac

SEQ ID NO: 21397 - RNA, 19 nt, Artificial Sequence
  Synthetic oligonucleotide
aacuguaguucacaaaacc

SEQ ID NO: 21398 - RNA, 19 nt, Artificial Sequence
  Synthetic oligonucleotide
acuguaguucacaaaacca

SEQ ID NO: 21399 - RNA, 19 nt, Artificial Sequence
  Synthetic oligonucleotide
cuguaguucacaaaaccag

SEQ ID NO: 21400 - RNA, 19 nt, Artificial Sequence
  Synthetic oligonucleotide
uguaguucacaaaaccagu

SEQ ID NO: 21401 - RNA, 19 nt, Artificial Sequence
  Synthetic oligonucleotide
guaguucacaaaaccagua

SEQ ID NO: 21402 - RNA, 19 nt, Artificial Sequence
  Synthetic oligonucleotide
uaguucacaaaaccaguac

SEQ ID NO: 21403 - RNA, 19 nt, Artificial Sequence
  Synthetic oligonucleotide
aguucacaaaaccaguacc

SEQ ID NO: 21404 - RNA, 19 nt, Artificial Sequence
  Synthetic oligonucleotide
guucacaaaaccaguaccu

SEQ ID NO: 21405 - RNA, 19 nt, Artificial Sequence
  Synthetic oligonucleotide
uucacaaaaccaguaccuc

SEQ ID NO: 21406 - RNA, 19 nt, Artificial Sequence
  Synthetic oligonucleotide
ucacaaaaccaguaccucu

SEQ ID NO: 21407 - RNA, 19 nt, Artificial Sequence
  Synthetic oligonucleotide
cacaaaaccaguaccucug

SEQ ID NO: 21408 - RNA, 19 nt, Artificial Sequence
  Synthetic oligonucleotide
acaaaaccaguaccucuga

SEQ ID NO: 21409 - RNA, 19 nt, Artificial Sequence
  Synthetic oligonucleotide
caaaaccaguaccucugag

SEQ ID NO: 21410 - RNA, 19 nt, Artificial Sequence
  Synthetic oligonucleotide
aaaaccaguaccucugagg

SEQ ID NO: 21411 - RNA, 19 nt, Artificial Sequence
  Synthetic oligonucleotide
aaaccaguaccucugagga

SEQ ID NO: 21412 - RNA, 19 nt, Artificial Sequence
  Synthetic oligonucleotide
aaccaguaccucugaggaa

SEQ ID NO: 21413 - RNA, 19 nt, Artificial Sequence
  Synthetic oligonucleotide
accaguaccucugaggaag

SEQ ID NO: 21414 - RNA, 19 nt, Artificial Sequence
  Synthetic oligonucleotide
ccaguaccucugaggaagu

SEQ ID NO: 21415 - RNA, 19 nt, Artificial Sequence
  Synthetic oligonucleotide
caguaccucugaggaaguu

SEQ ID NO: 21416 - RNA, 19 nt, Artificial Sequence
  Synthetic oligonucleotide
aguaccucugaggaaguuu

SEQ ID NO: 21417 - RNA, 19 nt, Artificial Sequence
  Synthetic oligonucleotide
guaccucugaggaaguuug

SEQ ID NO: 21418 - RNA, 19 nt, Artificial Sequence
  Synthetic oligonucleotide
uaccucugaggaaguuugc

SEQ ID NO: 21419 - RNA, 19 nt, Artificial Sequence
  Synthetic oligonucleotide
accucugaggaaguuugca

SEQ ID NO: 21420 - RNA, 19 nt, Artificial Sequence
  Synthetic oligonucleotide
ccucugaggaaguuugcag

SEQ ID NO: 21421 - RNA, 19 nt, Artificial Sequence
  Synthetic oligonucleotide
cucugaggaaguuugcagc

SEQ ID NO: 21422 - RNA, 19 nt, Artificial Sequence
  Synthetic oligonucleotide
ucugaggaaguuugcagcu

SEQ ID NO: 21423 - RNA, 19 nt, Artificial Sequence
  Synthetic oligonucleotide
guuugcagcuuuuauuuga

SEQ ID NO: 21424 - RNA, 19 nt, Artificial Sequence
  Synthetic oligonucleotide
uuugcagcuuuuauuugaa

SEQ ID NO: 21425 - RNA, 19 nt, Artificial Sequence
  Synthetic oligonucleotide
ucgauacucaggauauuga

SEQ ID NO: 21426 - RNA, 19 nt, Artificial Sequence
  Synthetic oligonucleotide
gauacucaggauauugaag

SEQ ID NO: 21427 - RNA, 19 nt, Artificial Sequence
  Synthetic oligonucleotide
auacucaggauauugaagc

SEQ ID NO: 21428 - RNA, 19 nt, Artificial Sequence
  Synthetic oligonucleotide
uacucaggauauugaagca

SEQ ID NO: 21429 - RNA, 19 nt, Artificial Sequence
  Synthetic oligonucleotide
acucaggauauugaagcau

SEQ ID NO: 21430 - RNA, 19 nt, Artificial Sequence
  Synthetic oligonucleotide
ucaggauauugaagcaucc

SEQ ID NO: 21431 - RNA, 19 nt, Artificial Sequence
  Synthetic oligonucleotide
caggauauugaagcauccc

SEQ ID NO: 21432 - RNA, 19 nt, Artificial Sequence
  Synthetic oligonucleotide
aggauauugaagcauccca

SEQ ID NO: 21433 - RNA, 19 nt, Artificial Sequence
  Synthetic oligonucleotide
ggauauugaagcaucccac

SEQ ID NO: 21434 - RNA, 19 nt, Artificial Sequence
  Synthetic oligonucleotide
gauauugaagcaucccacu

SEQ ID NO: 21435 - RNA, 19 nt, Artificial Sequence
  Synthetic oligonucleotide
auauugaagcaucccacua

SEQ ID NO: 21436 - RNA, 19 nt, Artificial Sequence
  Synthetic oligonucleotide
uauugaagcaucccacuac

SEQ ID NO: 21437 - RNA, 19 nt, Artificial Sequence
  Synthetic oligonucleotide
auugaagcaucccacuaca

SEQ ID NO: 21438 - RNA, 19 nt, Artificial Sequence
  Synthetic oligonucleotide
uugaagcaucccacuacag

SEQ ID NO: 21439 - RNA, 19 nt, Artificial Sequence
  Synthetic oligonucleotide
ugaagcaucccacuacaga

SEQ ID NO: 21440 - RNA, 19 nt, Artificial Sequence
  Synthetic oligonucleotide
gaagcaucccacuacagag

SEQ ID NO: 21441 - RNA, 19 nt, Artificial Sequence
  Synthetic oligonucleotide
aagcaucccacuacagagg

SEQ ID NO: 21442 - RNA, 19 nt, Artificial Sequence
  Synthetic oligonucleotide
agcaucccacuacagaggc

SEQ ID NO: 21443 - RNA, 19 nt, Artificial Sequence
  Synthetic oligonucleotide
gcaucccacuacagaggcu

SEQ ID NO: 21444 - RNA, 19 nt, Artificial Sequence
  Synthetic oligonucleotide
caucccacuacagaggcua

SEQ ID NO: 21445 - RNA, 19 nt, Artificial Sequence
  Synthetic oligonucleotide
aucccacuacagaggcuac

SEQ ID NO: 21446 - RNA, 19 nt, Artificial Sequence
  Synthetic oligonucleotide
ucccacuacagaggcuacg

SEQ ID NO: 21447 - RNA, 19 nt, Artificial Sequence
  Synthetic oligonucleotide
cccacuacagaggcuacgg

SEQ ID NO: 21448 - RNA, 19 nt, Artificial Sequence
  Synthetic oligonucleotide
ccacuacagaggcuacgga

SEQ ID NO: 21449 - RNA, 19 nt, Artificial Sequence
  Synthetic oligonucleotide
cacuacagaggcuacggaa

SEQ ID NO: 21450 - RNA, 19 nt, Artificial Sequence
  Synthetic oligonucleotide
acuacagaggcuacggaaa

SEQ ID NO: 21451 - RNA, 19 nt, Artificial Sequence
  Synthetic oligonucleotide
cuacagaggcuacggaaac

SEQ ID NO: 21452 - RNA, 19 nt, Artificial Sequence
  Synthetic oligonucleotide
uacagaggcuacggaaacu

SEQ ID NO: 21453 - RNA, 19 nt, Artificial Sequence
  Synthetic oligonucleotide
acagaggcuacggaaacuc

SEQ ID NO: 21454 - RNA, 19 nt, Artificial Sequence
  Synthetic oligonucleotide
cagaggcuacggaaacucu

SEQ ID NO: 21455 - RNA, 19 nt, Artificial Sequence
  Synthetic oligonucleotide
agaggcuacggaaacucug

SEQ ID NO: 21456 - RNA, 19 nt, Artificial Sequence
  Synthetic oligonucleotide
gaggcuacggaaacucuga

SEQ ID NO: 21457 - RNA, 19 nt, Artificial Sequence
  Synthetic oligonucleotide
aggcuacggaaacucugau

SEQ ID NO: 21458 - RNA, 19 nt, Artificial Sequence
  Synthetic oligonucleotide
ggcuacggaaacucugauu

SEQ ID NO: 21459 - RNA, 19 nt, Artificial Sequence
  Synthetic oligonucleotide
gcuacggaaacucugauua

SEQ ID NO: 21460 - RNA, 19 nt, Artificial Sequence
  Synthetic oligonucleotide
cuacggaaacucugauuac

SEQ ID NO: 21461 - RNA, 19 nt, Artificial Sequence
  Synthetic oligonucleotide
uacggaaacucugauuaca

SEQ ID NO: 21462 - RNA, 19 nt, Artificial Sequence
  Synthetic oligonucleotide
acggaaacucugauuacaa

SEQ ID NO: 21463 - RNA, 19 nt, Artificial Sequence
  Synthetic oligonucleotide
cggaaacucugauuacaaa

SEQ ID NO: 21464 - RNA, 19 nt, Artificial Sequence
  Synthetic oligonucleotide
ggaaacucugauuacaaac

SEQ ID NO: 21465 - RNA, 19 nt, Artificial Sequence
  Synthetic oligonucleotide
gaaacucugauuacaaacg

SEQ ID NO: 21466 - RNA, 19 nt, Artificial Sequence
  Synthetic oligonucleotide
aaacucugauuacaaacgc

SEQ ID NO: 21467 - RNA, 19 nt, Artificial Sequence
  Synthetic oligonucleotide
aacucugauuacaaacgca

SEQ ID NO: 21468 - RNA, 19 nt, Artificial Sequence
  Synthetic oligonucleotide
acucugauuacaaacgcau

SEQ ID NO: 21469 - RNA, 19 nt, Artificial Sequence
  Synthetic oligonucleotide
cucugauuacaaacgcaua

SEQ ID NO: 21470 - RNA, 19 nt, Artificial Sequence
  Synthetic oligonucleotide
ucugauuacaaacgcauag

SEQ ID NO: 21471 - RNA, 19 nt, Artificial Sequence
  Synthetic oligonucleotide
cugauuacaaacgcauagu

SEQ ID NO: 21472 - RNA, 19 nt, Artificial Sequence
  Synthetic oligonucleotide
ugauuacaaacgcauagua

SEQ ID NO: 21473 - RNA, 19 nt, Artificial Sequence
  Synthetic oligonucleotide
gauuacaaacgcauaguag

SEQ ID NO: 21474 - RNA, 19 nt, Artificial Sequence
  Synthetic oligonucleotide
auuacaaacgcauaguagc

SEQ ID NO: 21475 - RNA, 19 nt, Artificial Sequence
  Synthetic oligonucleotide
uuacaaacgcauaguagca

SEQ ID NO: 21476 - RNA, 19 nt, Artificial Sequence
  Synthetic oligonucleotide
uacaaacgcauaguagcau

SEQ ID NO: 21477 - RNA, 19 nt, Artificial Sequence
  Synthetic oligonucleotide
acaaacgcauaguagcaug

SEQ ID NO: 21478 - RNA, 19 nt, Artificial Sequence
  Synthetic oligonucleotide
caaacgcauaguagcaugu

SEQ ID NO: 21479 - RNA, 19 nt, Artificial Sequence
  Synthetic oligonucleotide
aaacgcauaguagcaugug

SEQ ID NO: 21480 - RNA, 19 nt, Artificial Sequence
  Synthetic oligonucleotide
aacgcauaguagcaugugc

SEQ ID NO: 21481 - RNA, 19 nt, Artificial Sequence
  Synthetic oligonucleotide
acgcauaguagcaugugcc

SEQ ID NO: 21482 - RNA, 19 nt, Artificial Sequence
  Synthetic oligonucleotide
cgcauaguagcaugugcca

SEQ ID NO: 21483 - RNA, 19 nt, Artificial Sequence
  Synthetic oligonucleotide
gcauaguagcaugugccag

SEQ ID NO: 21484 - RNA, 19 nt, Artificial Sequence
  Synthetic oligonucleotide
cauaguagcaugugccagc

SEQ ID NO: 21485 - RNA, 19 nt, Artificial Sequence
  Synthetic oligonucleotide
auaguagcaugugccagcu

SEQ ID NO: 21486 - RNA, 19 nt, Artificial Sequence
  Synthetic oligonucleotide
uaguagcaugugccagcua

SEQ ID NO: 21487 - RNA, 19 nt, Artificial Sequence
  Synthetic oligonucleotide
cggugauggacaucuccuu

SEQ ID NO: 21488 - RNA, 19 nt, Artificial Sequence
  Synthetic oligonucleotide
ggugauggacaucuccuug

SEQ ID NO: 21489 - RNA, 19 nt, Artificial Sequence
  Synthetic oligonucleotide
gugauggacaucuccuugc

SEQ ID NO: 21490 - RNA, 19 nt, Artificial Sequence
  Synthetic oligonucleotide
ugauggacaucuccuugcc

SEQ ID NO: 21491 - RNA, 19 nt, Artificial Sequence
  Synthetic oligonucleotide
gauggacaucuccuugccu

SEQ ID NO: 21492 - RNA, 19 nt, Artificial Sequence
  Synthetic oligonucleotide
auggacaucuccuugccua

SEQ ID NO: 21493 - RNA, 19 nt, Artificial Sequence
  Synthetic oligonucleotide
uggacaucuccuugccuac

SEQ ID NO: 21494 - RNA, 19 nt, Artificial Sequence
  Synthetic oligonucleotide
ggacaucuccuugccuacu

SEQ ID NO: 21495 - RNA, 19 nt, Artificial Sequence
  Synthetic oligonucleotide
gacaucuccuugccuacug

SEQ ID NO: 21496 - RNA, 19 nt, Artificial Sequence
  Synthetic oligonucleotide
acaucuccuugccuacugg

SEQ ID NO: 21497 - RNA, 19 nt, Artificial Sequence
  Synthetic oligonucleotide
caucuccuugccuacugga

SEQ ID NO: 21498 - RNA, 19 nt, Artificial Sequence
  Synthetic oligonucleotide
aucuccuugccuacuggaa

SEQ ID NO: 21499 - RNA, 19 nt, Artificial Sequence
  Synthetic oligonucleotide
ucuccuugccuacuggaau

SEQ ID NO: 21500 - RNA, 19 nt, Artificial Sequence
  Synthetic oligonucleotide
agugcaaaugaagaagacu

SEQ ID NO: 21501 - RNA, 19 nt, Artificial Sequence
  Synthetic oligonucleotide
gugcaaaugaagaagacuu

SEQ ID NO: 21502 - RNA, 19 nt, Artificial Sequence
  Synthetic oligonucleotide
ugcaaaugaagaagacuua

SEQ ID NO: 21503 - RNA, 19 nt, Artificial Sequence
  Synthetic oligonucleotide
gcaaaugaagaagacuuaa

SEQ ID NO: 21504 - RNA, 19 nt, Artificial Sequence
  Synthetic oligonucleotide
caaaugaagaagacuuaaa

SEQ ID NO: 21505 - RNA, 19 nt, Artificial Sequence
  Synthetic oligonucleotide
aaaugaagaagacuuaaaa

SEQ ID NO: 21506 - RNA, 19 nt, Artificial Sequence
  Synthetic oligonucleotide
cccuuguggaaggggugga

SEQ ID NO: 21507 - RNA, 19 nt, Artificial Sequence
  Synthetic oligonucleotide
ccuuguggaagggguggau

SEQ ID NO: 21508 - RNA, 19 nt, Artificial Sequence
  Synthetic oligonucleotide
aacuauucacugauuacca

SEQ ID NO: 21509 - RNA, 19 nt, Artificial Sequence
  Synthetic oligonucleotide
acuauucacugauuaccaa

SEQ ID NO: 21510 - RNA, 19 nt, Artificial Sequence
  Synthetic oligonucleotide
ucaaagauggacauguuau

SEQ ID NO: 21511 - RNA, 19 nt, Artificial Sequence
  Synthetic oligonucleotide
caaagauggacauguuauu

SEQ ID NO: 21512 - RNA, 19 nt, Artificial Sequence
  Synthetic oligonucleotide
aaagauggacauguuauuc

SEQ ID NO: 21513 - RNA, 19 nt, Artificial Sequence
  Synthetic oligonucleotide
gauggacauguuauucugc

SEQ ID NO: 21514 - RNA, 19 nt, Artificial Sequence
  Synthetic oligonucleotide
uggacauguuauucugcaa

SEQ ID NO: 21515 - RNA, 19 nt, Artificial Sequence
  Synthetic oligonucleotide
cauguuauucugcaacuga

SEQ ID NO: 21516 - RNA, 19 nt, Artificial Sequence
  Synthetic oligonucleotide
auguuauucugcaacugaa

SEQ ID NO: 21517 - RNA, 19 nt, Artificial Sequence
  Synthetic oligonucleotide
uguuauucugcaacugaau

SEQ ID NO: 21518 - RNA, 19 nt, Artificial Sequence
  Synthetic oligonucleotide
guuauucugcaacugaauu

SEQ ID NO: 21519 - RNA, 19 nt, Artificial Sequence
  Synthetic oligonucleotide
uauuugaacucuuugaagu

SEQ ID NO: 21520 - RNA, 19 nt, Artificial Sequence
  Synthetic oligonucleotide
auuugaacucuuugaaguu

SEQ ID NO: 21521 - RNA, 19 nt, Artificial Sequence
  Synthetic oligonucleotide
uuugaacucuuugaaguug

SEQ ID NO: 21522 - RNA, 19 nt, Artificial Sequence
  Synthetic oligonucleotide
uugaacucuuugaaguugg

SEQ ID NO: 21523 - RNA, 19 nt, Artificial Sequence
  Synthetic oligonucleotide
ugaacucuuugaaguuggg

SEQ ID NO: 21524 - RNA, 19 nt, Artificial Sequence
  Synthetic oligonucleotide
gaacucuuugaaguugggu

SEQ ID NO: 21525 - RNA, 19 nt, Artificial Sequence
  Synthetic oligonucleotide
aacucuuugaaguuggguu

SEQ ID NO: 21526 - RNA, 19 nt, Artificial Sequence
  Synthetic oligonucleotide
acucuuugaaguuggguuu

SEQ ID NO: 21527 - RNA, 19 nt, Artificial Sequence
  Synthetic oligonucleotide
ucaguccugccacuuucac

SEQ ID NO: 21528 - RNA, 19 nt, Artificial Sequence
  Synthetic oligonucleotide
caguccugccacuuucaca

SEQ ID NO: 21529 - RNA, 19 nt, Artificial Sequence
  Synthetic oligonucleotide
aguccugccacuuucacag

SEQ ID NO: 21530 - RNA, 19 nt, Artificial Sequence
  Synthetic oligonucleotide
guccugccacuuucacagu

SEQ ID NO: 21531 - RNA, 19 nt, Artificial Sequence
  Synthetic oligonucleotide
uccugccacuuucacagug

SEQ ID NO: 21532 - RNA, 19 nt, Artificial Sequence
  Synthetic oligonucleotide
acgaauaccacagaccaga

SEQ ID NO: 21533 - RNA, 19 nt, Artificial Sequence
  Synthetic oligonucleotide
cgaauaccacagaccagau

SEQ ID NO: 21534 - RNA, 19 nt, Artificial Sequence
  Synthetic oligonucleotide
gaauaccacagaccagaua

SEQ ID NO: 21535 - RNA, 19 nt, Artificial Sequence
  Synthetic oligonucleotide
aauaccacagaccagauaa

SEQ ID NO: 21536 - RNA, 19 nt, Artificial Sequence
  Synthetic oligonucleotide
auaccacagaccagauaaa

SEQ ID NO: 21537 - RNA, 19 nt, Artificial Sequence
  Synthetic oligonucleotide
uaccacagaccagauaaac

SEQ ID NO: 21538 - RNA, 19 nt, Artificial Sequence
  Synthetic oligonucleotide
accacagaccagauaaaca

SEQ ID NO: 21539 - RNA, 19 nt, Artificial Sequence
  Synthetic oligonucleotide
ccacagaccagauaaacag

SEQ ID NO: 21540 - RNA, 19 nt, Artificial Sequence
  Synthetic oligonucleotide
cacagaccagauaaacagu

SEQ ID NO: 21541 - RNA, 19 nt, Artificial Sequence
  Synthetic oligonucleotide
acagaccagauaaacagug

SEQ ID NO: 21542 - RNA, 19 nt, Artificial Sequence
  Synthetic oligonucleotide
cagaccagauaaacagugu

SEQ ID NO: 21543 - RNA, 19 nt, Artificial Sequence
  Synthetic oligonucleotide
agaccagauaaacagugua

SEQ ID NO: 21544 - RNA, 19 nt, Artificial Sequence
  Synthetic oligonucleotide
gaccagauaaacaguguac

SEQ ID NO: 21545 - RNA, 19 nt, Artificial Sequence
  Synthetic oligonucleotide
accagauaaacaguguacc

SEQ ID NO: 21546 - RNA, 19 nt, Artificial Sequence
  Synthetic oligonucleotide
ccagauaaacaguguacca

SEQ ID NO: 21547 - RNA, 19 nt, Artificial Sequence
  Synthetic oligonucleotide
gauaaacaguguaccaugu

SEQ ID NO: 21548 - RNA, 19 nt, Artificial Sequence
  Synthetic oligonucleotide
uaaacaguguaccauguuu

SEQ ID NO: 21549 - RNA, 19 nt, Artificial Sequence
  Synthetic oligonucleotide
aacaguguaccauguuuua

SEQ ID NO: 21550 - RNA, 19 nt, Artificial Sequence
  Synthetic oligonucleotide
acaguguaccauguuuuau

SEQ ID NO: 21551 - RNA, 19 nt, Artificial Sequence
  Synthetic oligonucleotide
caguguaccauguuuuaua

SEQ ID NO: 21552 - RNA, 19 nt, Artificial Sequence
  Synthetic oligonucleotide
aguguaccauguuuuauag

SEQ ID NO: 21553 - RNA, 19 nt, Artificial Sequence
  Synthetic oligonucleotide
guguaccauguuuuauagc

SEQ ID NO: 21554 - RNA, 19 nt, Artificial Sequence
  Synthetic oligonucleotide
uguaccauguuuuauagca

SEQ ID NO: 21555 - RNA, 19 nt, Artificial Sequence
  Synthetic oligonucleotide
guaccauguuuuauagcac

SEQ ID NO: 21556 - RNA, 19 nt, Artificial Sequence
  Synthetic oligonucleotide
uaccauguuuuauagcacu

SEQ ID NO: 21557 - RNA, 19 nt, Artificial Sequence
  Synthetic oligonucleotide
accauguuuuauagcacuu

SEQ ID NO: 21558 - RNA, 19 nt, Artificial Sequence
  Synthetic oligonucleotide
ccauguuuuauagcacuuc

SEQ ID NO: 21559 - RNA, 19 nt, Artificial Sequence
  Synthetic oligonucleotide
cauguuuuauagcacuucc

SEQ ID NO: 21560 - RNA, 19 nt, Artificial Sequence
  Synthetic oligonucleotide
auguuuuauagcacuucca

SEQ ID NO: 21561 - RNA, 19 nt, Artificial Sequence
  Synthetic oligonucleotide
uguuuuauagcacuuccaa

SEQ ID NO: 21562 - RNA, 19 nt, Artificial Sequence
  Synthetic oligonucleotide
guuuuauagcacuuccaau

SEQ ID NO: 21563 - RNA, 19 nt, Artificial Sequence
  Synthetic oligonucleotide
uuuuauagcacuuccaaua

SEQ ID NO: 21564 - RNA, 19 nt, Artificial Sequence
  Synthetic oligonucleotide
uuuauagcacuuccaauau

SEQ ID NO: 21565 - RNA, 19 nt, Artificial Sequence
  Synthetic oligonucleotide
uauagcacuuccaauauca

SEQ ID NO: 21566 - RNA, 19 nt, Artificial Sequence
  Synthetic oligonucleotide
auagcacuuccaauaucaa

SEQ ID NO: 21567 - RNA, 19 nt, Artificial Sequence
  Synthetic oligonucleotide
uagcacuuccaauaucaaa

SEQ ID NO: 21568 - RNA, 19 nt, Artificial Sequence
  Synthetic oligonucleotide
agcacuuccaauaucaaaa

SEQ ID NO: 21569 - RNA, 19 nt, Artificial Sequence
  Synthetic oligonucleotide
gcacuuccaauaucaaaau

SEQ ID NO: 21570 - RNA, 19 nt, Artificial Sequence
  Synthetic oligonucleotide
cacuuccaauaucaaaauu

SEQ ID NO: 21571 - RNA, 19 nt, Artificial Sequence
  Synthetic oligonucleotide
acuuccaauaucaaaauuc

SEQ ID NO: 21572 - RNA, 19 nt, Artificial Sequence
  Synthetic oligonucleotide
cuuccaauaucaaaauuca

SEQ ID NO: 21573 - RNA, 19 nt, Artificial Sequence
  Synthetic oligonucleotide
uuccaauaucaaaauucag

SEQ ID NO: 21574 - RNA, 19 nt, Artificial Sequence
  Synthetic oligonucleotide
uccaauaucaaaauucaga

SEQ ID NO: 21575 - RNA, 19 nt, Artificial Sequence
  Synthetic oligonucleotide
ccaauaucaaaauucagaa

SEQ ID NO: 21576 - RNA, 19 nt, Artificial Sequence
  Synthetic oligonucleotide
caauaucaaaauucagaaa

SEQ ID NO: 21577 - RNA, 19 nt, Artificial Sequence
  Synthetic oligonucleotide
aauaucaaaauucagaaag

SEQ ID NO: 21578 - RNA, 19 nt, Artificial Sequence
  Synthetic oligonucleotide
auaucaaaauucagaaagu

SEQ ID NO: 21579 - RNA, 19 nt, Artificial Sequence
  Synthetic oligonucleotide
uaucaaaauucagaaaguc

SEQ ID NO: 21580 - RNA, 19 nt, Artificial Sequence
  Synthetic oligonucleotide
aucaaaauucagaaagucu

SEQ ID NO: 21581 - RNA, 19 nt, Artificial Sequence
  Synthetic oligonucleotide
ucaaaauucagaaagucug

SEQ ID NO: 21582 - RNA, 19 nt, Artificial Sequence
  Synthetic oligonucleotide
caaaauucagaaagucugu

SEQ ID NO: 21583 - RNA, 19 nt, Artificial Sequence
  Synthetic oligonucleotide
aaaauucagaaagucugug

SEQ ID NO: 21584 - RNA, 19 nt, Artificial Sequence
  Synthetic oligonucleotide
aaauucagaaagucuguga

SEQ ID NO: 21585 - RNA, 19 nt, Artificial Sequence
  Synthetic oligonucleotide
cagaaagucugugaaggag

SEQ ID NO: 21586 - RNA, 19 nt, Artificial Sequence
  Synthetic oligonucleotide
uguagaagcugauuguggg

SEQ ID NO: 21587 - RNA, 19 nt, Artificial Sequence
  Synthetic oligonucleotide
guagaagcugauugugggc

SEQ ID NO: 21588 - RNA, 19 nt, Artificial Sequence
  Synthetic oligonucleotide
uagaagcugauugugggca

SEQ ID NO: 21589 - RNA, 19 nt, Artificial Sequence
  Synthetic oligonucleotide
agaagcugauugugggcaa

SEQ ID NO: 21590 - RNA, 19 nt, Artificial Sequence
  Synthetic oligonucleotide
gaagcugauugugggcaaa

SEQ ID NO: 21591 - RNA, 19 nt, Artificial Sequence
  Synthetic oligonucleotide
aagcugauugugggcaaau

SEQ ID NO: 21592 - RNA, 19 nt, Artificial Sequence
  Synthetic oligonucleotide
agcugauugugggcaaaug

SEQ ID NO: 21593 - RNA, 19 nt, Artificial Sequence
  Synthetic oligonucleotide
gcugauugugggcaaaugc

SEQ ID NO: 21594 - RNA, 19 nt, Artificial Sequence
  Synthetic oligonucleotide
ggaagaauuggaucugaca

SEQ ID NO: 21595 - RNA, 19 nt, Artificial Sequence
  Synthetic oligonucleotide
gaagaauuggaucugacaa

SEQ ID NO: 21596 - RNA, 19 nt, Artificial Sequence
  Synthetic oligonucleotide
aagaauuggaucugacaau

SEQ ID NO: 21597 - RNA, 19 nt, Artificial Sequence
  Synthetic oligonucleotide
agaauuggaucugacaauc

SEQ ID NO: 21598 - RNA, 19 nt, Artificial Sequence
  Synthetic oligonucleotide
gaauuggaucugacaaucu

SEQ ID NO: 21599 - RNA, 19 nt, Artificial Sequence
  Synthetic oligonucleotide
aauuggaucugacaaucuc

SEQ ID NO: 21600 - RNA, 19 nt, Artificial Sequence
  Synthetic oligonucleotide
auuggaucugacaaucucu

SEQ ID NO: 21601 - RNA, 19 nt, Artificial Sequence
  Synthetic oligonucleotide
uuggaucugacaaucucug

SEQ ID NO: 21602 - RNA, 19 nt, Artificial Sequence
  Synthetic oligonucleotide
uggaucugacaaucucugc

SEQ ID NO: 21603 - RNA, 19 nt, Artificial Sequence
  Synthetic oligonucleotide
ggaucugacaaucucugca

SEQ ID NO: 21604 - RNA, 19 nt, Artificial Sequence
  Synthetic oligonucleotide
gaucugacaaucucugcag

SEQ ID NO: 21605 - RNA, 19 nt, Artificial Sequence
  Synthetic oligonucleotide
aucugacaaucucugcaga

SEQ ID NO: 21606 - RNA, 19 nt, Artificial Sequence
  Synthetic oligonucleotide
ucugacaaucucugcagag

SEQ ID NO: 21607 - RNA, 19 nt, Artificial Sequence
  Synthetic oligonucleotide
caagaaaacaaacagcaug

SEQ ID NO: 21608 - RNA, 19 nt, Artificial Sequence
  Synthetic oligonucleotide
aagaaaacaaacagcaugu

SEQ ID NO: 21609 - RNA, 19 nt, Artificial Sequence
  Synthetic oligonucleotide
gagauugcauaugcuuaua

SEQ ID NO: 21610 - RNA, 19 nt, Artificial Sequence
  Synthetic oligonucleotide
agauugcauaugcuuauaa

SEQ ID NO: 21611 - RNA, 19 nt, Artificial Sequence
  Synthetic oligonucleotide
gauugcauaugcuuauaaa

SEQ ID NO: 21612 - RNA, 19 nt, Artificial Sequence
  Synthetic oligonucleotide
auugcauaugcuuauaaag

SEQ ID NO: 21613 - RNA, 19 nt, Artificial Sequence
  Synthetic oligonucleotide
uugcauaugcuuauaaagu

SEQ ID NO: 21614 - RNA, 19 nt, Artificial Sequence
  Synthetic oligonucleotide
aaauguuuuugucaaguac

SEQ ID NO: 21615 - RNA, 19 nt, Artificial Sequence
  Synthetic oligonucleotide
aauguuuuugucaaguaca

SEQ ID NO: 21616 - RNA, 19 nt, Artificial Sequence
  Synthetic oligonucleotide
auguuuuugucaaguacaa

SEQ ID NO: 21617 - RNA, 19 nt, Artificial Sequence
  Synthetic oligonucleotide
uguuuuugucaaguacaag

SEQ ID NO: 21618 - RNA, 19 nt, Artificial Sequence
  Synthetic oligonucleotide
guuuuugucaaguacaagg

SEQ ID NO: 21619 - RNA, 19 nt, Artificial Sequence
  Synthetic oligonucleotide
uuuuugucaaguacaaggc

SEQ ID NO: 21620 - RNA, 19 nt, Artificial Sequence
  Synthetic oligonucleotide
uuuugucaaguacaaggca

SEQ ID NO: 21621 - RNA, 19 nt, Artificial Sequence
  Synthetic oligonucleotide
uuugucaaguacaaggcaa

SEQ ID NO: 21622 - RNA, 19 nt, Artificial Sequence
  Synthetic oligonucleotide
uugucaaguacaaggcaac

SEQ ID NO: 21623 - RNA, 19 nt, Artificial Sequence
  Synthetic oligonucleotide
ugucaaguacaaggcaacc

SEQ ID NO: 21624 - RNA, 19 nt, Artificial Sequence
  Synthetic oligonucleotide
gucaaguacaaggcaaccc

SEQ ID NO: 21625 - RNA, 19 nt, Artificial Sequence
  Synthetic oligonucleotide
ucaaguacaaggcaacccu

SEQ ID NO: 21626 - RNA, 19 nt, Artificial Sequence
  Synthetic oligonucleotide
caaguacaaggcaacccuu

SEQ ID NO: 21627 - RNA, 19 nt, Artificial Sequence
  Synthetic oligonucleotide
aaguacaaggcaacccuuc

SEQ ID NO: 21628 - RNA, 19 nt, Artificial Sequence
  Synthetic oligonucleotide
aguacaaggcaacccuucu

SEQ ID NO: 21629 - RNA, 19 nt, Artificial Sequence
  Synthetic oligonucleotide
guacaaggcaacccuucug

SEQ ID NO: 21630 - RNA, 19 nt, Artificial Sequence
  Synthetic oligonucleotide
uacaaggcaacccuucugg

SEQ ID NO: 21631 - RNA, 19 nt, Artificial Sequence
  Synthetic oligonucleotide
acaaggcaacccuucugga

SEQ ID NO: 21632 - RNA, 19 nt, Artificial Sequence
  Synthetic oligonucleotide
caaggcaacccuucuggau

SEQ ID NO: 21633 - RNA, 19 nt, Artificial Sequence
  Synthetic oligonucleotide
aaggcaacccuucuggaua

SEQ ID NO: 21634 - RNA, 19 nt, Artificial Sequence
  Synthetic oligonucleotide
aggcaacccuucuggauau

SEQ ID NO: 21635 - RNA, 19 nt, Artificial Sequence
  Synthetic oligonucleotide
ggcaacccuucuggauauc

SEQ ID NO: 21636 - RNA, 19 nt, Artificial Sequence
  Synthetic oligonucleotide
gcaacccuucuggauaucu

SEQ ID NO: 21637 - RNA, 19 nt, Artificial Sequence
  Synthetic oligonucleotide
caacccuucuggauaucua

SEQ ID NO: 21638 - RNA, 19 nt, Artificial Sequence
  Synthetic oligonucleotide
aacccuucuggauaucuac

SEQ ID NO: 21639 - RNA, 19 nt, Artificial Sequence
  Synthetic oligonucleotide
acccuucuggauaucuaca

SEQ ID NO: 21640 - RNA, 19 nt, Artificial Sequence
  Synthetic oligonucleotide
cccuucuggauaucuacaa

SEQ ID NO: 21641 - RNA, 19 nt, Artificial Sequence
  Synthetic oligonucleotide
ccuucuggauaucuacaaa

SEQ ID NO: 21642 - RNA, 19 nt, Artificial Sequence
  Synthetic oligonucleotide
cuucuggauaucuacaaaa

SEQ ID NO: 21643 - RNA, 19 nt, Artificial Sequence
  Synthetic oligonucleotide
uucuggauaucuacaaaac

SEQ ID NO: 21644 - RNA, 19 nt, Artificial Sequence
  Synthetic oligonucleotide
ucuggauaucuacaaaacu

SEQ ID NO: 21645 - RNA, 19 nt, Artificial Sequence
  Synthetic oligonucleotide
cuggauaucuacaaaacug

SEQ ID NO: 21646 - RNA, 19 nt, Artificial Sequence
  Synthetic oligonucleotide
uggauaucuacaaaacugg

SEQ ID NO: 21647 - RNA, 19 nt, Artificial Sequence
  Synthetic oligonucleotide
ggauaucuacaaaacuggg

SEQ ID NO: 21648 - RNA, 19 nt, Artificial Sequence
  Synthetic oligonucleotide
gauaucuacaaaacugggg

SEQ ID NO: 21649 - RNA, 19 nt, Artificial Sequence
  Synthetic oligonucleotide
auaucuacaaaacugggga

SEQ ID NO: 21650 - RNA, 19 nt, Artificial Sequence
  Synthetic oligonucleotide
uaucuacaaaacuggggaa

SEQ ID NO: 21651 - RNA, 19 nt, Artificial Sequence
  Synthetic oligonucleotide
aucuacaaaacuggggaag

SEQ ID NO: 21652 - RNA, 19 nt, Artificial Sequence
  Synthetic oligonucleotide
ucuacaaaacuggggaagc

SEQ ID NO: 21653 - RNA, 19 nt, Artificial Sequence
  Synthetic oligonucleotide
cuacaaaacuggggaagcu

SEQ ID NO: 21654 - RNA, 19 nt, Artificial Sequence
  Synthetic oligonucleotide
uacaaaacuggggaagcug

SEQ ID NO: 21655 - RNA, 19 nt, Artificial Sequence
  Synthetic oligonucleotide
acaaaacuggggaagcugu

SEQ ID NO: 21656 - RNA, 19 nt, Artificial Sequence
  Synthetic oligonucleotide
caaaacuggggaagcuguu

SEQ ID NO: 21657 - RNA, 19 nt, Artificial Sequence
  Synthetic oligonucleotide
aaaacuggggaagcuguug

SEQ ID NO: 21658 - RNA, 19 nt, Artificial Sequence
  Synthetic oligonucleotide
aaacuggggaagcuguugc

SEQ ID NO: 21659 - RNA, 19 nt, Artificial Sequence
  Synthetic oligonucleotide
aacuggggaagcuguugcu

SEQ ID NO: 21660 - RNA, 19 nt, Artificial Sequence
  Synthetic oligonucleotide
uuaccuucauuaaaaaggu

SEQ ID NO: 21661 - RNA, 19 nt, Artificial Sequence
  Synthetic oligonucleotide
uaccuucauuaaaaaggua

SEQ ID NO: 21662 - RNA, 19 nt, Artificial Sequence
  Synthetic oligonucleotide
accuucauuaaaaagguaa

SEQ ID NO: 21663 - RNA, 19 nt, Artificial Sequence
  Synthetic oligonucleotide
ccuucauuaaaaagguaac

SEQ ID NO: 21664 - RNA, 19 nt, Artificial Sequence
  Synthetic oligonucleotide
cuucauuaaaaagguaacc

SEQ ID NO: 21665 - RNA, 19 nt, Artificial Sequence
  Synthetic oligonucleotide
uaaaaggaagacaguacuu

SEQ ID NO: 21666 - RNA, 19 nt, Artificial Sequence
  Synthetic oligonucleotide
aaaaggaagacaguacuua

SEQ ID NO: 21667 - RNA, 19 nt, Artificial Sequence
  Synthetic oligonucleotide
aaaggaagacaguacuuaa

SEQ ID NO: 21668 - RNA, 19 nt, Artificial Sequence
  Synthetic oligonucleotide
aaggaagacaguacuuaau

SEQ ID NO: 21669 - RNA, 19 nt, Artificial Sequence
  Synthetic oligonucleotide
aggaagacaguacuuaauu

SEQ ID NO: 21670 - RNA, 19 nt, Artificial Sequence
  Synthetic oligonucleotide
ggaagacaguacuuaauua

SEQ ID NO: 21671 - RNA, 19 nt, Artificial Sequence
  Synthetic oligonucleotide
gaagacaguacuuaauuau

SEQ ID NO: 21672 - RNA, 19 nt, Artificial Sequence
  Synthetic oligonucleotide
aagacaguacuuaauuaug

SEQ ID NO: 21673 - RNA, 19 nt, Artificial Sequence
  Synthetic oligonucleotide
cccuccagauaaaauacaa

SEQ ID NO: 21674 - RNA, 19 nt, Artificial Sequence
  Synthetic oligonucleotide
ccuccagauaaaauacaau

SEQ ID NO: 21675 - RNA, 19 nt, Artificial Sequence
  Synthetic oligonucleotide
uccagauaaaauacaauuu

SEQ ID NO: 21676 - RNA, 19 nt, Artificial Sequence
  Synthetic oligonucleotide
aguuucagguacaucuacc

SEQ ID NO: 21677 - RNA, 19 nt, Artificial Sequence
  Synthetic oligonucleotide
guuucagguacaucuaccc

SEQ ID NO: 21678 - RNA, 19 nt, Artificial Sequence
  Synthetic oligonucleotide
uuucagguacaucuacccu

SEQ ID NO: 21679 - RNA, 19 nt, Artificial Sequence
  Synthetic oligonucleotide
uucagguacaucuacccuu

SEQ ID NO: 21680 - RNA, 19 nt, Artificial Sequence
  Synthetic oligonucleotide
ucagguacaucuacccuuu

SEQ ID NO: 21681 - RNA, 19 nt, Artificial Sequence
  Synthetic oligonucleotide
cagguacaucuacccuuua

SEQ ID NO: 21682 - RNA, 19 nt, Artificial Sequence
  Synthetic oligonucleotide
agguacaucuacccuuuag

SEQ ID NO: 21683 - RNA, 19 nt, Artificial Sequence
  Synthetic oligonucleotide
gguacaucuacccuuuaga

SEQ ID NO: 21684 - RNA, 19 nt, Artificial Sequence
  Synthetic oligonucleotide
guacaucuacccuuuagau

SEQ ID NO: 21685 - RNA, 19 nt, Artificial Sequence
  Synthetic oligonucleotide
uacaucuacccuuuagauu

SEQ ID NO: 21686 - RNA, 19 nt, Artificial Sequence
  Synthetic oligonucleotide
acaucuacccuuuagauuc

SEQ ID NO: 21687 - RNA, 19 nt, Artificial Sequence
  Synthetic oligonucleotide
caucuacccuuuagauucc

SEQ ID NO: 21688 - RNA, 19 nt, Artificial Sequence
  Synthetic oligonucleotide
aucuacccuuuagauuccu

SEQ ID NO: 21689 - RNA, 19 nt, Artificial Sequence
  Synthetic oligonucleotide
ucuacccuuuagauuccuu

SEQ ID NO: 21690 - RNA, 19 nt, Artificial Sequence
  Synthetic oligonucleotide
cuacccuuuagauuccuug

SEQ ID NO: 21691 - RNA, 19 nt, Artificial Sequence
  Synthetic oligonucleotide
uacccuuuagauuccuuga

SEQ ID NO: 21692 - RNA, 19 nt, Artificial Sequence
  Synthetic oligonucleotide
acccuuuagauuccuugac

SEQ ID NO: 21693 - RNA, 19 nt, Artificial Sequence
  Synthetic oligonucleotide
cccuuuagauuccuugacc

SEQ ID NO: 21694 - RNA, 19 nt, Artificial Sequence
  Synthetic oligonucleotide
ccuuuagauuccuugaccu

SEQ ID NO: 21695 - RNA, 19 nt, Artificial Sequence
  Synthetic oligonucleotide
cuuuagauuccuugaccug

SEQ ID NO: 21696 - RNA, 19 nt, Artificial Sequence
  Synthetic oligonucleotide
uuuagauuccuugaccugg

SEQ ID NO: 21697 - RNA, 19 nt, Artificial Sequence
  Synthetic oligonucleotide
uuagauuccuugaccugga

SEQ ID NO: 21698 - RNA, 19 nt, Artificial Sequence
  Synthetic oligonucleotide
uagauuccuugaccuggau

SEQ ID NO: 21699 - RNA, 19 nt, Artificial Sequence
  Synthetic oligonucleotide
agauuccuugaccuggauu

SEQ ID NO: 21700 - RNA, 19 nt, Artificial Sequence
  Synthetic oligonucleotide
gauuccuugaccuggauug

SEQ ID NO: 21701 - RNA, 19 nt, Artificial Sequence
  Synthetic oligonucleotide
auuccuugaccuggauuga

SEQ ID NO: 21702 - RNA, 19 nt, Artificial Sequence
  Synthetic oligonucleotide
uuccuugaccuggauugaa

SEQ ID NO: 21703 - RNA, 19 nt, Artificial Sequence
  Synthetic oligonucleotide
uccuugaccuggauugaau

SEQ ID NO: 21704 - RNA, 19 nt, Artificial Sequence
  Synthetic oligonucleotide
ccuugaccuggauugaaua

SEQ ID NO: 21705 - RNA, 19 nt, Artificial Sequence
  Synthetic oligonucleotide
cuugaccuggauugaauac

SEQ ID NO: 21706 - RNA, 19 nt, Artificial Sequence
  Synthetic oligonucleotide
uugaccuggauugaauacu

SEQ ID NO: 21707 - RNA, 19 nt, Artificial Sequence
  Synthetic oligonucleotide
ugaccuggauugaauacug

SEQ ID NO: 21708 - RNA, 19 nt, Artificial Sequence
  Synthetic oligonucleotide
gaccuggauugaauacugg

SEQ ID NO: 21709 - RNA, 19 nt, Artificial Sequence
  Synthetic oligonucleotide
accuggauugaauacuggc

SEQ ID NO: 21710 - RNA, 19 nt, Artificial Sequence
  Synthetic oligonucleotide
ccuggauugaauacuggcc

SEQ ID NO: 21711 - RNA, 19 nt, Artificial Sequence
  Synthetic oligonucleotide
cuggauugaauacuggccu

SEQ ID NO: 21712 - RNA, 19 nt, Artificial Sequence
  Synthetic oligonucleotide
cacaacauguucaucgugu

SEQ ID NO: 21713 - RNA, 19 nt, Artificial Sequence
  Synthetic oligonucleotide
acaacauguucaucguguc

SEQ ID NO: 21714 - RNA, 19 nt, Artificial Sequence
  Synthetic oligonucleotide
caacauguucaucguguca

SEQ ID NO: 21715 - RNA, 19 nt, Artificial Sequence
  Synthetic oligonucleotide
aacauguucaucgugucaa

SEQ ID NO: 21716 - RNA, 19 nt, Artificial Sequence
  Synthetic oligonucleotide
cauguucaucgugucaagc

SEQ ID NO: 21717 - RNA, 19 nt, Artificial Sequence
  Synthetic oligonucleotide
auguucaucgugucaagca

SEQ ID NO: 21718 - RNA, 19 nt, Artificial Sequence
  Synthetic oligonucleotide
uguucaucgugucaagcau

SEQ ID NO: 21719 - RNA, 19 nt, Artificial Sequence
  Synthetic oligonucleotide
guucaucgugucaagcauu

SEQ ID NO: 21720 - RNA, 19 nt, Artificial Sequence
  Synthetic oligonucleotide
ucaucgugucaagcauuuu

SEQ ID NO: 21721 - RNA, 19 nt, Artificial Sequence
  Synthetic oligonucleotide
caucgugucaagcauuuuu

SEQ ID NO: 21722 - RNA, 19 nt, Artificial Sequence
  Synthetic oligonucleotide
aucgugucaagcauuuuua

SEQ ID NO: 21723 - RNA, 19 nt, Artificial Sequence
  Synthetic oligonucleotide
cgugucaagcauuuuuagc

SEQ ID NO: 21724 - RNA, 19 nt, Artificial Sequence
  Synthetic oligonucleotide
gugucaagcauuuuuagcu

SEQ ID NO: 21725 - RNA, 19 nt, Artificial Sequence
  Synthetic oligonucleotide
ugucaagcauuuuuagcua

SEQ ID NO: 21726 - RNA, 19 nt, Artificial Sequence
  Synthetic oligonucleotide
gucaagcauuuuuagcuaa

SEQ ID NO: 21727 - RNA, 19 nt, Artificial Sequence
  Synthetic oligonucleotide
caagcauuuuuagcuaauu

SEQ ID NO: 21728 - RNA, 19 nt, Artificial Sequence
  Synthetic oligonucleotide
aagcauuuuuagcuaauuu

SEQ ID NO: 21729 - RNA, 19 nt, Artificial Sequence
  Synthetic oligonucleotide
agcauuuuuagcuaauuua

SEQ ID NO: 21730 - RNA, 19 nt, Artificial Sequence
  Synthetic oligonucleotide
gcauuuuuagcuaauuuag

SEQ ID NO: 21731 - RNA, 19 nt, Artificial Sequence
  Synthetic oligonucleotide
cauuuuuagcuaauuuaga

SEQ ID NO: 21732 - RNA, 19 nt, Artificial Sequence
  Synthetic oligonucleotide
auuuuuagcuaauuuagau

SEQ ID NO: 21733 - RNA, 19 nt, Artificial Sequence
  Synthetic oligonucleotide
uuuuuagcuaauuuagaug

SEQ ID NO: 21734 - RNA, 19 nt, Artificial Sequence
  Synthetic oligonucleotide
uuuuagcuaauuuagauga

SEQ ID NO: 21735 - RNA, 19 nt, Artificial Sequence
  Synthetic oligonucleotide
uuuagcuaauuuagaugaa

SEQ ID NO: 21736 - RNA, 19 nt, Artificial Sequence
  Synthetic oligonucleotide
uuagcuaauuuagaugaau

SEQ ID NO: 21737 - RNA, 19 nt, Artificial Sequence
  Synthetic oligonucleotide
uagcuaauuuagaugaauu

SEQ ID NO: 21738 - RNA, 19 nt, Artificial Sequence
  Synthetic oligonucleotide
agcuaauuuagaugaauuu

SEQ ID NO: 21739 - RNA, 19 nt, Artificial Sequence
  Synthetic oligonucleotide
auaucuuuuuaaauggaug

SEQ ID NO: 21740 - RNA, 19 nt, Artificial Sequence
  Synthetic oligonucleotide
uaucuuuuuaaauggaugc

SEQ ID NO: 21741 - RNA, 19 nt, Artificial Sequence
  Synthetic oligonucleotide
aucuuuuuaaauggaugcu

SEQ ID NO: 21742 - RNA, 19 nt, Artificial Sequence
  Synthetic oligonucleotide
ucuuuuuaaauggaugcua

SEQ ID NO: 21743 - RNA, 19 nt, Artificial Sequence
  Synthetic oligonucleotide
cuuuuuaaauggaugcuaa

SEQ ID NO: 21744 - RNA, 19 nt, Artificial Sequence
  Synthetic oligonucleotide
uuuuuaaauggaugcuaaa

SEQ ID NO: 21745 - RNA, 19 nt, Artificial Sequence
  Synthetic oligonucleotide
uuuuaaauggaugcuaaaa

SEQ ID NO: 21746 - RNA, 19 nt, Artificial Sequence
  Synthetic oligonucleotide
uuuaaauggaugcuaaaau

SEQ ID NO: 21747 - RNA, 19 nt, Artificial Sequence
  Synthetic oligonucleotide
uuaaauggaugcuaaaauu

SEQ ID NO: 21748 - RNA, 19 nt, Artificial Sequence
  Synthetic oligonucleotide
uaaauggaugcuaaaauuc

SEQ ID NO: 21749 - RNA, 19 nt, Artificial Sequence
  Synthetic oligonucleotide
aaauggaugcuaaaauucc

SEQ ID NO: 21750 - RNA, 19 nt, Artificial Sequence
  Synthetic oligonucleotide
auggaugcuaaaauuccug

SEQ ID NO: 21751 - RNA, 19 nt, Artificial Sequence
  Synthetic oligonucleotide
uggaugcuaaaauuccuga

SEQ ID NO: 21752 - RNA, 19 nt, Artificial Sequence
  Synthetic oligonucleotide
ggaugcuaaaauuccugaa

SEQ ID NO: 21753 - RNA, 19 nt, Artificial Sequence
  Synthetic oligonucleotide
gaugcuaaaauuccugaag

SEQ ID NO: 21754 - RNA, 19 nt, Artificial Sequence
  Synthetic oligonucleotide
augcuaaaauuccugaagu

SEQ ID NO: 21755 - RNA, 19 nt, Artificial Sequence
  Synthetic oligonucleotide
ugcuaaaauuccugaaguu

SEQ ID NO: 21756 - RNA, 19 nt, Artificial Sequence
  Synthetic oligonucleotide
gcuaaaauuccugaaguuc

SEQ ID NO: 21757 - RNA, 19 nt, Artificial Sequence
  Synthetic oligonucleotide
cuaaaauuccugaaguuca

SEQ ID NO: 21758 - RNA, 19 nt, Artificial Sequence
  Synthetic oligonucleotide
uaaaauuccugaaguucag

SEQ ID NO: 21759 - RNA, 19 nt, Artificial Sequence
  Synthetic oligonucleotide
aaaauuccugaaguucagc

SEQ ID NO: 21760 - RNA, 19 nt, Artificial Sequence
  Synthetic oligonucleotide
aaauuccugaaguucagcu

SEQ ID NO: 21761 - RNA, 19 nt, Artificial Sequence
  Synthetic oligonucleotide
aauuccugaaguucagcug

SEQ ID NO: 21762 - RNA, 19 nt, Artificial Sequence
  Synthetic oligonucleotide
auuccugaaguucagcugc

SEQ ID NO: 21763 - RNA, 19 nt, Artificial Sequence
  Synthetic oligonucleotide
uuccugaaguucagcugca

SEQ ID NO: 21764 - RNA, 19 nt, Artificial Sequence
  Synthetic oligonucleotide
uccugaaguucagcugcau

SEQ ID NO: 21765 - RNA, 19 nt, Artificial Sequence
  Synthetic oligonucleotide
ccugaaguucagcugcaua

SEQ ID NO: 21766 - RNA, 19 nt, Artificial Sequence
  Synthetic oligonucleotide
cugaaguucagcugcauac

SEQ ID NO: 21767 - RNA, 19 nt, Artificial Sequence
  Synthetic oligonucleotide
ugaaguucagcugcauaca

SEQ ID NO: 21768 - RNA, 19 nt, Artificial Sequence
  Synthetic oligonucleotide
gaaguucagcugcauacag

SEQ ID NO: 21769 - RNA, 19 nt, Artificial Sequence
  Synthetic oligonucleotide
aaguucagcugcauacagu

SEQ ID NO: 21770 - RNA, 19 nt, Artificial Sequence
  Synthetic oligonucleotide
aguucagcugcauacaguu

SEQ ID NO: 21771 - RNA, 19 nt, Artificial Sequence
  Synthetic oligonucleotide
guucagcugcauacaguuu

SEQ ID NO: 21772 - RNA, 19 nt, Artificial Sequence
  Synthetic oligonucleotide
uucagcugcauacaguuug

SEQ ID NO: 21773 - RNA, 19 nt, Artificial Sequence
  Synthetic oligonucleotide
ucagcugcauacaguuugc

SEQ ID NO: 21774 - RNA, 19 nt, Artificial Sequence
  Synthetic oligonucleotide
cagcugcauacaguuugca

SEQ ID NO: 21775 - RNA, 19 nt, Artificial Sequence
  Synthetic oligonucleotide
agcugcauacaguuugcac

SEQ ID NO: 21776 - RNA, 19 nt, Artificial Sequence
  Synthetic oligonucleotide
gcugcauacaguuugcacu

SEQ ID NO: 21777 - RNA, 19 nt, Artificial Sequence
  Synthetic oligonucleotide
cugcauacaguuugcacuu

SEQ ID NO: 21778 - RNA, 19 nt, Artificial Sequence
  Synthetic oligonucleotide
ugcauacaguuugcacuua

SEQ ID NO: 21779 - RNA, 19 nt, Artificial Sequence
  Synthetic oligonucleotide
gcauacaguuugcacuuau

SEQ ID NO: 21780 - RNA, 19 nt, Artificial Sequence
  Synthetic oligonucleotide
cauacaguuugcacuuaug

SEQ ID NO: 21781 - RNA, 19 nt, Artificial Sequence
  Synthetic oligonucleotide
auacaguuugcacuuaugg

SEQ ID NO: 21782 - RNA, 19 nt, Artificial Sequence
  Synthetic oligonucleotide
uacaguuugcacuuaugga

SEQ ID NO: 21783 - RNA, 19 nt, Artificial Sequence
  Synthetic oligonucleotide
acaguuugcacuuauggac

SEQ ID NO: 21784 - RNA, 19 nt, Artificial Sequence
  Synthetic oligonucleotide
caguuugcacuuauggacu

SEQ ID NO: 21785 - RNA, 19 nt, Artificial Sequence
  Synthetic oligonucleotide
aguuugcacuuauggacuc

SEQ ID NO: 21786 - RNA, 19 nt, Artificial Sequence
  Synthetic oligonucleotide
guuugcacuuauggacucc

SEQ ID NO: 21787 - RNA, 19 nt, Artificial Sequence
  Synthetic oligonucleotide
uuugcacuuauggacuccu

SEQ ID NO: 21788 - RNA, 19 nt, Artificial Sequence
  Synthetic oligonucleotide
uugcacuuauggacuccug

SEQ ID NO: 21789 - RNA, 19 nt, Artificial Sequence
  Synthetic oligonucleotide
ugcacuuauggacuccugu

SEQ ID NO: 21790 - RNA, 19 nt, Artificial Sequence
  Synthetic oligonucleotide
gcacuuauggacuccuguu

SEQ ID NO: 21791 - RNA, 19 nt, Artificial Sequence
  Synthetic oligonucleotide
cacuuauggacuccuguug

SEQ ID NO: 21792 - RNA, 19 nt, Artificial Sequence
  Synthetic oligonucleotide
acuuauggacuccuguugu

SEQ ID NO: 21793 - RNA, 19 nt, Artificial Sequence
  Synthetic oligonucleotide
cuuauggacuccuguuguu

SEQ ID NO: 21794 - RNA, 19 nt, Artificial Sequence
  Synthetic oligonucleotide
uauggacuccuguuguuga

SEQ ID NO: 21795 - RNA, 19 nt, Artificial Sequence
  Synthetic oligonucleotide
auagcuggucuuauuugua

SEQ ID NO: 21796 - RNA, 19 nt, Artificial Sequence
  Synthetic oligonucleotide
uagcuggucuuauuuguaa

SEQ ID NO: 21797 - RNA, 19 nt, Artificial Sequence
  Synthetic oligonucleotide
agcuggucuuauuuguaaa

SEQ ID NO: 21798 - RNA, 19 nt, Artificial Sequence
  Synthetic oligonucleotide
gcuggucuuauuuguaaag

SEQ ID NO: 21799 - RNA, 19 nt, Artificial Sequence
  Synthetic oligonucleotide
cuggucuuauuuguaaagc

SEQ ID NO: 21800 - RNA, 19 nt, Artificial Sequence
  Synthetic oligonucleotide
uggucuuauuuguaaagcu

SEQ ID NO: 21801 - RNA, 19 nt, Artificial Sequence
  Synthetic oligonucleotide
ggucuuauuuguaaagcuc

SEQ ID NO: 21802 - RNA, 19 nt, Artificial Sequence
  Synthetic oligonucleotide
gucuuauuuguaaagcuca

SEQ ID NO: 21803 - RNA, 19 nt, Artificial Sequence
  Synthetic oligonucleotide
ucuuauuuguaaagcucac

SEQ ID NO: 21804 - RNA, 19 nt, Artificial Sequence
  Synthetic oligonucleotide
cuuauuuguaaagcucacu

SEQ ID NO: 21805 - RNA, 19 nt, Artificial Sequence
  Synthetic oligonucleotide
uuauuuguaaagcucacuu

SEQ ID NO: 21806 - RNA, 19 nt, Artificial Sequence
  Synthetic oligonucleotide
uauuuguaaagcucacuuu

SEQ ID NO: 21807 - RNA, 19 nt, Artificial Sequence
  Synthetic oligonucleotide
auuuguaaagcucacuuua

SEQ ID NO: 21808 - RNA, 19 nt, Artificial Sequence
  Synthetic oligonucleotide
uuuguaaagcucacuuuac

SEQ ID NO: 21809 - RNA, 19 nt, Artificial Sequence
  Synthetic oligonucleotide
uuguaaagcucacuuuacu

SEQ ID NO: 21810 - RNA, 19 nt, Artificial Sequence
  Synthetic oligonucleotide
uguaaagcucacuuuacuu

SEQ ID NO: 21811 - RNA, 19 nt, Artificial Sequence
  Synthetic oligonucleotide
guaaagcucacuuuacuua

SEQ ID NO: 21812 - RNA, 19 nt, Artificial Sequence
  Synthetic oligonucleotide
uaaagcucacuuuacuuag

SEQ ID NO: 21813 - RNA, 19 nt, Artificial Sequence
  Synthetic oligonucleotide
aaagcucacuuuacuuaga

SEQ ID NO: 21814 - RNA, 19 nt, Artificial Sequence
  Synthetic oligonucleotide
aagcucacuuuacuuagaa

SEQ ID NO: 21815 - RNA, 19 nt, Artificial Sequence
  Synthetic oligonucleotide
agcucacuuuacuuagaau

SEQ ID NO: 21816 - RNA, 19 nt, Artificial Sequence
  Synthetic oligonucleotide
gcucacuuuacuuagaauu

SEQ ID NO: 21817 - RNA, 19 nt, Artificial Sequence
  Synthetic oligonucleotide
cucacuuuacuuagaauua

SEQ ID NO: 21818 - RNA, 19 nt, Artificial Sequence
  Synthetic oligonucleotide
ucacuuuacuuagaauuag

SEQ ID NO: 21819 - RNA, 19 nt, Artificial Sequence
  Synthetic oligonucleotide
cacuuuacuuagaauuagu

SEQ ID NO: 21820 - RNA, 19 nt, Artificial Sequence
  Synthetic oligonucleotide
acuuuacuuagaauuagug

SEQ ID NO: 21821 - RNA, 19 nt, Artificial Sequence
  Synthetic oligonucleotide
cuuuacuuagaauuagugg

SEQ ID NO: 21822 - RNA, 19 nt, Artificial Sequence
  Synthetic oligonucleotide
uuuacuuagaauuaguggc

SEQ ID NO: 21823 - RNA, 19 nt, Artificial Sequence
  Synthetic oligonucleotide
uuacuuagaauuaguggca

SEQ ID NO: 21824 - RNA, 19 nt, Artificial Sequence
  Synthetic oligonucleotide
uacuuagaauuaguggcac

SEQ ID NO: 21825 - RNA, 19 nt, Artificial Sequence
  Synthetic oligonucleotide
acuuagaauuaguggcacu

SEQ ID NO: 21826 - RNA, 19 nt, Artificial Sequence
  Synthetic oligonucleotide
cuuagaauuaguggcacuu

SEQ ID NO: 21827 - RNA, 19 nt, Artificial Sequence
  Synthetic oligonucleotide
uuagaauuaguggcacuug

SEQ ID NO: 21828 - RNA, 19 nt, Artificial Sequence
  Synthetic oligonucleotide
uagaauuaguggcacuugc

SEQ ID NO: 21829 - RNA, 19 nt, Artificial Sequence
  Synthetic oligonucleotide
agaauuaguggcacuugcu

SEQ ID NO: 21830 - RNA, 19 nt, Artificial Sequence
  Synthetic oligonucleotide
gaauuaguggcacuugcuu

SEQ ID NO: 21831 - RNA, 19 nt, Artificial Sequence
  Synthetic oligonucleotide
aauuaguggcacuugcuuu

SEQ ID NO: 21832 - RNA, 19 nt, Artificial Sequence
  Synthetic oligonucleotide
auuaguggcacuugcuuuu

SEQ ID NO: 21833 - RNA, 19 nt, Artificial Sequence
  Synthetic oligonucleotide
uuaguggcacuugcuuuua

SEQ ID NO: 21834 - RNA, 19 nt, Artificial Sequence
  Synthetic oligonucleotide
uaguggcacuugcuuuuau

SEQ ID NO: 21835 - RNA, 19 nt, Artificial Sequence
  Synthetic oligonucleotide
aguggcacuugcuuuuauu

SEQ ID NO: 21836 - RNA, 19 nt, Artificial Sequence
  Synthetic oligonucleotide
guggcacuugcuuuuauua

SEQ ID NO: 21837 - RNA, 19 nt, Artificial Sequence
  Synthetic oligonucleotide
uggcacuugcuuuuauuag

SEQ ID NO: 21838 - RNA, 19 nt, Artificial Sequence
  Synthetic oligonucleotide
ggcacuugcuuuuauuaga

SEQ ID NO: 21839 - RNA, 19 nt, Artificial Sequence
  Synthetic oligonucleotide
gcacuugcuuuuauuagag

SEQ ID NO: 21840 - RNA, 19 nt, Artificial Sequence
  Synthetic oligonucleotide
cacuugcuuuuauuagaga

SEQ ID NO: 21841 - RNA, 19 nt, Artificial Sequence
  Synthetic oligonucleotide
gcuuuuauuagagaaugau

SEQ ID NO: 21842 - RNA, 19 nt, Artificial Sequence
  Synthetic oligonucleotide
augcuguaacuuucugaaa

SEQ ID NO: 21843 - RNA, 19 nt, Artificial Sequence
  Synthetic oligonucleotide
ugcuguaacuuucugaaau

SEQ ID NO: 21844 - RNA, 19 nt, Artificial Sequence
  Synthetic oligonucleotide
gcuguaacuuucugaaaua

SEQ ID NO: 21845 - RNA, 19 nt, Artificial Sequence
  Synthetic oligonucleotide
cuguaacuuucugaaauaa

SEQ ID NO: 21846 - RNA, 19 nt, Artificial Sequence
  Synthetic oligonucleotide
uguaacuuucugaaauaac

SEQ ID NO: 21847 - RNA, 19 nt, Artificial Sequence
  Synthetic oligonucleotide
guaacuuucugaaauaaca

SEQ ID NO: 21848 - RNA, 19 nt, Artificial Sequence
  Synthetic oligonucleotide
uaacuuucugaaauaacau

SEQ ID NO: 21849 - RNA, 19 nt, Artificial Sequence
  Synthetic oligonucleotide
aacuuucugaaauaacaug

SEQ ID NO: 21850 - RNA, 19 nt, Artificial Sequence
  Synthetic oligonucleotide
acuuucugaaauaacaugg

SEQ ID NO: 21851 - RNA, 19 nt, Artificial Sequence
  Synthetic oligonucleotide
cuuucugaaauaacauggc

SEQ ID NO: 21852 - RNA, 19 nt, Artificial Sequence
  Synthetic oligonucleotide
uuucugaaauaacauggcc

SEQ ID NO: 21853 - RNA, 19 nt, Artificial Sequence
  Synthetic oligonucleotide
uucugaaauaacauggccu

SEQ ID NO: 21854 - RNA, 19 nt, Artificial Sequence
  Synthetic oligonucleotide
ucugaaauaacauggccuu

SEQ ID NO: 21855 - RNA, 19 nt, Artificial Sequence
  Synthetic oligonucleotide
cugaaauaacauggccuug

SEQ ID NO: 21856 - RNA, 19 nt, Artificial Sequence
  Synthetic oligonucleotide
ugaaauaacauggccuugg

SEQ ID NO: 21857 - RNA, 19 nt, Artificial Sequence
  Synthetic oligonucleotide
gaaauaacauggccuugga

SEQ ID NO: 21858 - RNA, 19 nt, Artificial Sequence
  Synthetic oligonucleotide
aaauaacauggccuuggag

SEQ ID NO: 21859 - RNA, 19 nt, Artificial Sequence
  Synthetic oligonucleotide
aauaacauggccuuggagg

SEQ ID NO: 21860 - RNA, 19 nt, Artificial Sequence
  Synthetic oligonucleotide
auaacauggccuuggaggg

SEQ ID NO: 21861 - RNA, 19 nt, Artificial Sequence
  Synthetic oligonucleotide
uaacauggccuuggagggc

SEQ ID NO: 21862 - RNA, 19 nt, Artificial Sequence
  Synthetic oligonucleotide
aacauggccuuggagggca

SEQ ID NO: 21863 - RNA, 19 nt, Artificial Sequence
  Synthetic oligonucleotide
acauggccuuggagggcau

SEQ ID NO: 21864 - RNA, 19 nt, Artificial Sequence
  Synthetic oligonucleotide
cauggccuuggagggcaug

SEQ ID NO: 21865 - RNA, 19 nt, Artificial Sequence
  Synthetic oligonucleotide
auggccuuggagggcauga

SEQ ID NO: 21866 - RNA, 19 nt, Artificial Sequence
  Synthetic oligonucleotide
uggccuuggagggcaugaa

SEQ ID NO: 21867 - RNA, 19 nt, Artificial Sequence
  Synthetic oligonucleotide
ggccuuggagggcaugaag

SEQ ID NO: 21868 - RNA, 19 nt, Artificial Sequence
  Synthetic oligonucleotide
gccuuggagggcaugaaga

SEQ ID NO: 21869 - RNA, 19 nt, Artificial Sequence
  Synthetic oligonucleotide
ccuuggagggcaugaagac

SEQ ID NO: 21870 - RNA, 19 nt, Artificial Sequence
  Synthetic oligonucleotide
cuuggagggcaugaagaca

SEQ ID NO: 21871 - RNA, 19 nt, Artificial Sequence
  Synthetic oligonucleotide
uuggagggcaugaagacag

SEQ ID NO: 21872 - RNA, 19 nt, Artificial Sequence
  Synthetic oligonucleotide
uggagggcaugaagacaga

SEQ ID NO: 21873 - RNA, 19 nt, Artificial Sequence
  Synthetic oligonucleotide
ggagggcaugaagacagau

SEQ ID NO: 21874 - RNA, 19 nt, Artificial Sequence
  Synthetic oligonucleotide
gagggcaugaagacagaua

SEQ ID NO: 21875 - RNA, 19 nt, Artificial Sequence
  Synthetic oligonucleotide
agggcaugaagacagauac

SEQ ID NO: 21876 - RNA, 19 nt, Artificial Sequence
  Synthetic oligonucleotide
gggcaugaagacagauacu

SEQ ID NO: 21877 - RNA, 19 nt, Artificial Sequence
  Synthetic oligonucleotide
ggcaugaagacagauacuc

SEQ ID NO: 21878 - RNA, 19 nt, Artificial Sequence
  Synthetic oligonucleotide
gcaugaagacagauacucc

SEQ ID NO: 21879 - RNA, 19 nt, Artificial Sequence
  Synthetic oligonucleotide
caugaagacagauacuccu

SEQ ID NO: 21880 - RNA, 19 nt, Artificial Sequence
  Synthetic oligonucleotide
augaagacagauacuccuc

SEQ ID NO: 21881 - RNA, 19 nt, Artificial Sequence
  Synthetic oligonucleotide
ugaagacagauacuccucc

SEQ ID NO: 21882 - RNA, 19 nt, Artificial Sequence
  Synthetic oligonucleotide
gaagacagauacuccucca

SEQ ID NO: 21883 - RNA, 19 nt, Artificial Sequence
  Synthetic oligonucleotide
aagacagauacuccuccaa

SEQ ID NO: 21884 - RNA, 19 nt, Artificial Sequence
  Synthetic oligonucleotide
agacagauacuccuccaag

SEQ ID NO: 21885 - RNA, 19 nt, Artificial Sequence
  Synthetic oligonucleotide
acagauacuccuccaaggu

SEQ ID NO: 21886 - RNA, 19 nt, Artificial Sequence
  Synthetic oligonucleotide
cagauacuccuccaagguu

SEQ ID NO: 21887 - RNA, 19 nt, Artificial Sequence
  Synthetic oligonucleotide
agauacuccuccaagguua

SEQ ID NO: 21888 - RNA, 19 nt, Artificial Sequence
  Synthetic oligonucleotide
gauacuccuccaagguuau

SEQ ID NO: 21889 - RNA, 19 nt, Artificial Sequence
  Synthetic oligonucleotide
auacuccuccaagguuauu

SEQ ID NO: 21890 - RNA, 19 nt, Artificial Sequence
  Synthetic oligonucleotide
uacuccuccaagguuauug

SEQ ID NO: 21891 - RNA, 19 nt, Artificial Sequence
  Synthetic oligonucleotide
acuccuccaagguuauugg

SEQ ID NO: 21892 - RNA, 19 nt, Artificial Sequence
  Synthetic oligonucleotide
cuccuccaagguuauugga

SEQ ID NO: 21893 - RNA, 19 nt, Artificial Sequence
  Synthetic oligonucleotide
uccuccaagguuauuggac

SEQ ID NO: 21894 - RNA, 19 nt, Artificial Sequence
  Synthetic oligonucleotide
ccuccaagguuauuggaca

SEQ ID NO: 21895 - RNA, 19 nt, Artificial Sequence
  Synthetic oligonucleotide
cuccaagguuauuggacac

SEQ ID NO: 21896 - RNA, 19 nt, Artificial Sequence
  Synthetic oligonucleotide
uccaagguuauuggacacc

SEQ ID NO: 21897 - RNA, 19 nt, Artificial Sequence
  Synthetic oligonucleotide
ccaagguuauuggacaccg

SEQ ID NO: 21898 - RNA, 19 nt, Artificial Sequence
  Synthetic oligonucleotide
caagguuauuggacaccgg

SEQ ID NO: 21899 - RNA, 19 nt, Artificial Sequence
  Synthetic oligonucleotide
aagguuauuggacaccgga

SEQ ID NO: 21900 - RNA, 19 nt, Artificial Sequence
  Synthetic oligonucleotide
agguuauuggacaccggaa

SEQ ID NO: 21901 - RNA, 19 nt, Artificial Sequence
  Synthetic oligonucleotide
gguuauuggacaccggaaa

SEQ ID NO: 21902 - RNA, 19 nt, Artificial Sequence
  Synthetic oligonucleotide
guuauuggacaccggaaac

SEQ ID NO: 21903 - RNA, 19 nt, Artificial Sequence
  Synthetic oligonucleotide
uuauuggacaccggaaaca

SEQ ID NO: 21904 - RNA, 19 nt, Artificial Sequence
  Synthetic oligonucleotide
uauuggacaccggaaacaa

SEQ ID NO: 21905 - RNA, 19 nt, Artificial Sequence
  Synthetic oligonucleotide
auuggacaccggaaacaau

SEQ ID NO: 21906 - RNA, 19 nt, Artificial Sequence
  Synthetic oligonucleotide
uuggacaccggaaacaaua

SEQ ID NO: 21907 - RNA, 19 nt, Artificial Sequence
  Synthetic oligonucleotide
uggacaccggaaacaauaa

SEQ ID NO: 21908 - RNA, 19 nt, Artificial Sequence
  Synthetic oligonucleotide
ggacaccggaaacaauaaa

SEQ ID NO: 21909 - RNA, 19 nt, Artificial Sequence
  Synthetic oligonucleotide
uggaacaccuccucaaacc

SEQ ID NO: 21910 - RNA, 19 nt, Artificial Sequence
  Synthetic oligonucleotide
ggaacaccuccucaaaccu

SEQ ID NO: 21911 - RNA, 19 nt, Artificial Sequence
  Synthetic oligonucleotide
gaacaccuccucaaaccua

SEQ ID NO: 21912 - RNA, 19 nt, Artificial Sequence
  Synthetic oligonucleotide
aacaccuccucaaaccuac

SEQ ID NO: 21913 - RNA, 19 nt, Artificial Sequence
  Synthetic oligonucleotide
acaccuccucaaaccuacc

SEQ ID NO: 21914 - RNA, 19 nt, Artificial Sequence
  Synthetic oligonucleotide
caccuccucaaaccuacca

SEQ ID NO: 21915 - RNA, 19 nt, Artificial Sequence
  Synthetic oligonucleotide
gggccgaaagaacagucca

SEQ ID NO: 21916 - RNA, 19 nt, Artificial Sequence
  Synthetic oligonucleotide
ggccgaaagaacaguccau

SEQ ID NO: 21917 - RNA, 19 nt, Artificial Sequence
  Synthetic oligonucleotide
gccgaaagaacaguccauu

SEQ ID NO: 21918 - RNA, 19 nt, Artificial Sequence
  Synthetic oligonucleotide
ccgaaagaacaguccauug

SEQ ID NO: 21919 - RNA, 19 nt, Artificial Sequence
  Synthetic oligonucleotide
cgaaagaacaguccauuga

SEQ ID NO: 21920 - RNA, 19 nt, Artificial Sequence
  Synthetic oligonucleotide
agggaguauuacaaaaaca

SEQ ID NO: 21921 - RNA, 19 nt, Artificial Sequence
  Synthetic oligonucleotide
gggaguauuacaaaaacau

SEQ ID NO: 21922 - RNA, 19 nt, Artificial Sequence
  Synthetic oligonucleotide
ggaguauuacaaaaacaug

SEQ ID NO: 21923 - RNA, 19 nt, Artificial Sequence
  Synthetic oligonucleotide
gaguauuacaaaaacaugg

SEQ ID NO: 21924 - RNA, 19 nt, Artificial Sequence
  Synthetic oligonucleotide
aguauuacaaaaacauggc

SEQ ID NO: 21925 - RNA, 19 nt, Artificial Sequence
  Synthetic oligonucleotide
guauuacaaaaacauggcc

SEQ ID NO: 21926 - RNA, 19 nt, Artificial Sequence
  Synthetic oligonucleotide
uauuacaaaaacauggccu

SEQ ID NO: 21927 - RNA, 19 nt, Artificial Sequence
  Synthetic oligonucleotide
auuacaaaaacauggccuu

SEQ ID NO: 21928 - RNA, 19 nt, Artificial Sequence
  Synthetic oligonucleotide
uuacaaaaacauggccuuu

SEQ ID NO: 21929 - RNA, 19 nt, Artificial Sequence
  Synthetic oligonucleotide
uacaaaaacauggccuuug

SEQ ID NO: 21930 - RNA, 19 nt, Artificial Sequence
  Synthetic oligonucleotide
acaaaaacauggccuuugc

SEQ ID NO: 21931 - RNA, 19 nt, Artificial Sequence
  Synthetic oligonucleotide
caaaaacauggccuuugcu

SEQ ID NO: 21932 - RNA, 19 nt, Artificial Sequence
  Synthetic oligonucleotide
aaaaacauggccuuugcuu

SEQ ID NO: 21933 - RNA, 19 nt, Artificial Sequence
  Synthetic oligonucleotide
aaaacauggccuuugcuug

SEQ ID NO: 21934 - RNA, 19 nt, Artificial Sequence
  Synthetic oligonucleotide
aaacauggccuuugcuuga

SEQ ID NO: 21935 - RNA, 19 nt, Artificial Sequence
  Synthetic oligonucleotide
aacauggccuuugcuugaa

SEQ ID NO: 21936 - RNA, 19 nt, Artificial Sequence
  Synthetic oligonucleotide
acauggccuuugcuugaaa

SEQ ID NO: 21937 - RNA, 19 nt, Artificial Sequence
  Synthetic oligonucleotide
cauggccuuugcuugaaag

SEQ ID NO: 21938 - RNA, 19 nt, Artificial Sequence
  Synthetic oligonucleotide
auggccuuugcuugaaaga

SEQ ID NO: 21939 - RNA, 19 nt, Artificial Sequence
  Synthetic oligonucleotide
uggccuuugcuugaaagaa

SEQ ID NO: 21940 - RNA, 19 nt, Artificial Sequence
  Synthetic oligonucleotide
ggccuuugcuugaaagaaa

SEQ ID NO: 21941 - RNA, 19 nt, Artificial Sequence
  Synthetic oligonucleotide
gccuuugcuugaaagaaaa

SEQ ID NO: 21942 - RNA, 19 nt, Artificial Sequence
  Synthetic oligonucleotide
ccuuugcuugaaagaaaau

SEQ ID NO: 21943 - RNA, 19 nt, Artificial Sequence
  Synthetic oligonucleotide
cuuugcuugaaagaaaaua

SEQ ID NO: 21944 - RNA, 19 nt, Artificial Sequence
  Synthetic oligonucleotide
uuugcuugaaagaaaauac

SEQ ID NO: 21945 - RNA, 19 nt, Artificial Sequence
  Synthetic oligonucleotide
gaacaggaaacugaucauu

SEQ ID NO: 21946 - RNA, 19 nt, Artificial Sequence
  Synthetic oligonucleotide
aacaggaaacugaucauua

SEQ ID NO: 21947 - RNA, 19 nt, Artificial Sequence
  Synthetic oligonucleotide
acaggaaacugaucauuaa

SEQ ID NO: 21948 - RNA, 19 nt, Artificial Sequence
  Synthetic oligonucleotide
caggaaacugaucauuaaa

SEQ ID NO: 21949 - RNA, 19 nt, Artificial Sequence
  Synthetic oligonucleotide
aggaaacugaucauuaaag

SEQ ID NO: 21950 - RNA, 19 nt, Artificial Sequence
  Synthetic oligonucleotide
ggaaacugaucauuaaagc

SEQ ID NO: 21951 - RNA, 19 nt, Artificial Sequence
  Synthetic oligonucleotide
gaaacugaucauuaaagcc

SEQ ID NO: 21952 - RNA, 19 nt, Artificial Sequence
  Synthetic oligonucleotide
aaacugaucauuaaagccu

SEQ ID NO: 21953 - RNA, 19 nt, Artificial Sequence
  Synthetic oligonucleotide
aacugaucauuaaagccug

SEQ ID NO: 21954 - RNA, 19 nt, Artificial Sequence
  Synthetic oligonucleotide
acugaucauuaaagccuga

SEQ ID NO: 21955 - RNA, 19 nt, Artificial Sequence
  Synthetic oligonucleotide
cugaucauuaaagccugag

SEQ ID NO: 21956 - RNA, 19 nt, Artificial Sequence
  Synthetic oligonucleotide
ugaucauuaaagccugagu

SEQ ID NO: 21957 - RNA, 19 nt, Artificial Sequence
  Synthetic oligonucleotide
gaucauuaaagccugaguu

SEQ ID NO: 21958 - RNA, 19 nt, Artificial Sequence
  Synthetic oligonucleotide
cauuaaagccugaguuugc

SEQ ID NO: 21959 - RNA, 19 nt, Artificial Sequence
  Synthetic oligonucleotide
auuaaagccugaguuugcu
